(12) United States Patent
Doudna et al.

(10) Patent No.: US 11,970,719 B2
(45) Date of Patent: *Apr. 30, 2024

(54) CLASS 2 CRISPR/Cas COMPOSITIONS AND METHODS OF USE

(71) Applicant: The Regents of the University of California, Oakland, CA (US)

(72) Inventors: Jennifer A. Doudna, Berkeley, CA (US); David Burstein, Berkeley, CA (US); Janice S. Chen, Berkeley, CA (US); Lucas B. Harrington, Berkeley, CA (US); David Paez-Espino, Walnut Creek, CA (US); Jillian F. Banfield, Berkeley, CA (US)

(73) Assignee: The Regents of the University of California, Oakland (CA)

( * ) Notice: Subject to any disclaimer, the term of this patent is extended or adjusted under 35 U.S.C. 154(b) by 615 days.

This patent is subject to a terminal disclaimer.

(21) Appl. No.: 16/755,535

(22) PCT Filed: Oct. 31, 2018

(86) PCT No.: PCT/US2018/058529
§ 371 (c)(1),
(2) Date: Apr. 10, 2020

(87) PCT Pub. No.: WO2019/089808
PCT Pub. Date: May 9, 2019

(65) Prior Publication Data
US 2021/0214697 A1     Jul. 15, 2021

Related U.S. Application Data

(60) Provisional application No. 62/580,394, filed on Nov. 1, 2017.

(51) Int. Cl.
C12N 9/22 (2006.01)
C12N 15/11 (2006.01)
C12N 15/82 (2006.01)

(52) U.S. Cl.
CPC ............... *C12N 9/22* (2013.01); *C12N 15/11* (2013.01); *C12N 15/8213* (2013.01); *C12N 2310/20* (2017.05)

(58) Field of Classification Search
None
See application file for complete search history.

(56) References Cited

U.S. PATENT DOCUMENTS 6,773,885 B1  8/2004  Walder et al.
8,597,886 B2  12/2013 Smith et al.
(Continued)

FOREIGN PATENT DOCUMENTS

CN  1886512 A   12/2006
CN  101283089 A  10/2008
(Continued)

OTHER PUBLICATIONS

Hyun, Site-directed mutagenesis in *Arabidopsis thaliana* using dividing tissue-targeted RGEN of the CRISPR/Cas system to generate heritable null alleles, Planta, 2015 (Year: 2015).*

(Continued)

*Primary Examiner* — Matthew R Keogh
*Assistant Examiner* — Rebecca Stephens
(74) *Attorney, Agent, or Firm* — Bozicevic, Field & Francis, LLP; Kyle A. Gurley

(57) ABSTRACT

Provided are compositions and methods that include one or more of: (1) a Class 2 CRISPR/Cas effector protein, a nucleic acid encoding the effector protein, and/or a modified host cell comprising the effector protein (and/or a nucleic acid encoding the same); (2) a CRISPR/Cas guide RNA that (Continued)

binds to and provides sequence specificity to the Class 2 CRISPR/Cas effector protein, a nucleic acid encoding the CRISPR/Cas guide RNA, and/or a modified host cell comprising the CRISPR/Cas guide RNA (and/or a nucleic acid encoding the same); and (3) a CRISPR/Cas transactivating noncoding RNA (trancRNA), a nucleic acid encoding the CRISPR/Cas trancRNA, and/or a modified host cell comprising the CRISPR/Cas trancRNA (and/or a nucleic acid encoding the same).

18 Claims, 170 Drawing Sheets

Specification includes a Sequence Listing.

(56) References Cited

U.S. PATENT DOCUMENTS

| | | | |
|---|---|---|---|
| 8,815,782 | B2 | 8/2014 | Zeiner et al. |
| 9,730,967 | B2 | 6/2017 | Kovarik et al. |
| 9,790,490 | B2 | 10/2017 | Zhang et al. |
| 10,253,365 | B1 | 4/2019 | Doudna et al. |
| 10,266,886 | B2 | 4/2019 | Abudayyeh et al. |
| 10,316,324 | B2 | 6/2019 | Begemann et al. |
| 10,337,051 | B2 | 7/2019 | Doudna et al. |
| 10,494,664 | B2 | 12/2019 | Doudna et al. |
| 10,570,415 | B2 | 2/2020 | Doudna et al. |
| 11,180,743 | B2 * | 11/2021 | Doudna ............... C12Q 1/6809 |
| 11,453,866 | B2 * | 9/2022 | Doudna ............... C12Q 1/6816 |
| 2013/0261196 | A1 | 10/2013 | Diamond et al. |
| 2014/0068797 | A1 | 3/2014 | Doudna et al. |
| 2014/0093883 | A1 | 4/2014 | Maples et al. |
| 2014/0273226 | A1 | 9/2014 | Wu |
| 2015/0211058 | A1 | 7/2015 | Carstens |
| 2016/0017366 | A1 | 1/2016 | Chen et al. |
| 2016/0138008 | A1 | 5/2016 | Charpentier et al. |
| 2016/0208243 | A1 | 7/2016 | Zhang et al. |
| 2016/0289659 | A1 | 10/2016 | Doudna et al. |
| 2017/0037432 | A1 | 2/2017 | Donohoue et al. |
| 2017/0051276 | A1 | 2/2017 | May et al. |
| 2017/0175104 | A1 | 6/2017 | Doudna et al. |
| 2017/0198277 | A1 | 7/2017 | Kmiec et al. |
| 2017/0211142 | A1 | 7/2017 | Smargon et al. |
| 2017/0233756 | A1 | 8/2017 | Begemann et al. |
| 2017/0306335 | A1 | 10/2017 | Zhang et al. |
| 2017/0321198 | A1 | 11/2017 | Severinov et al. |
| 2017/0321214 | A1 | 11/2017 | Zhang et al. |
| 2017/0369870 | A1 | 12/2017 | Gill et al. |
| 2018/0340218 | A1 | 11/2018 | Abudayyeh et al. |
| 2019/0276842 | A1 | 9/2019 | Doudna et al. |
| 2019/0300908 | A1 * | 10/2019 | Doudna ............... C12N 15/902 |
| 2020/0017879 | A1 | 1/2020 | Doudna et al. |
| 2020/0087640 | A1 | 3/2020 | Doudna et al. |
| 2020/0255858 | A1 * | 8/2020 | Doudna ............... C12N 15/102 |
| 2020/0339967 | A1 * | 10/2020 | Doudna ............... C07K 19/00 |
| 2021/0166783 | A1 | 6/2021 | Shmakov et al. |
| 2022/0396812 | A1 * | 12/2022 | Doudna ............... C12N 15/113 |

FOREIGN PATENT DOCUMENTS

| | | |
|---|---|---|
| CN | 106701830 A | 5/2017 |
| EP | 1580273 A1 | 9/2005 |
| EP | 3009511 A2 | 4/2016 |
| JP | 2004521606 A | 7/2004 |
| WO | WO 2015/071474 | 5/2015 |
| WO | WO 2015/139139 | 9/2015 |
| WO | WO 2015/191693 | 12/2015 |
| WO | WO 2016/094872 | 12/2015 |
| WO | WO 2016/106236 | 12/2015 |
| WO | WO 2016/028843 | 2/2016 |
| WO | WO 2016/094867 | 6/2016 |
| WO | WO 2016/205711 | 6/2016 |
| WO | WO 2016/123243 | 8/2016 |
| WO | WO 2016/205613 | 12/2016 |
| WO | WO 2016/205749 | 12/2016 |
| WO | WO 2016/205764 | 12/2016 |
| WO | WO 2017/070605 | 4/2017 |
| WO | WO 2017/205668 | 5/2017 |
| WO | WO 2017/120410 | 7/2017 |
| WO | WO 2017/147345 | 8/2017 |
| WO | WO 2017/176529 | 10/2017 |
| WO | WO 2017/218573 | 12/2017 |
| WO | WO 2017/219027 | 12/2017 |
| WO | WO 2017/223538 | 12/2017 |
| WO | WO 2018/064352 | 4/2018 |
| WO | WO 2018/064371 | 4/2018 |
| WO | WO 2018/107129 | 6/2018 |
| WO | WO 2018/172556 | 9/2018 |
| WO | WO 2018/195545 | 10/2018 |
| WO | WO 2019/030695 | 2/2019 |
| WO | WO 2019/089796 | 5/2019 |
| WO | WO 2019/089804 | 5/2019 |
| WO | WO 2019/089808 | 5/2019 |
| WO | WO 2019/089820 | 5/2019 |
| WO | WO 2019/126577 | 6/2019 |

OTHER PUBLICATIONS

GenBank Accession No. KU516197.1 entitled "Uncultured bacterium GWB1_scaffold_10668 CRISPR-Cas system-like gene, complete sequence" dated 2016 (4 total pages). (Year: 2016).*
Lander et al. "Genome Editing by CRISPR/Cas9: a Game Change in the Genetic Manipulation of Protists" (2016 J Eukaryot Microbiol. 63(5): 679-690) (Year: 2016).*
Bursten et al. "Major bacterial lineages are essentially devoid of CRISPR-Cas viral defence systems" (2016 Nat Commun 7: 10613, DOI:10.1038/ncomms 10613 (8 total pages)) (Year: 2016).*
Makarova, et al.; "SnapShot: Class 2 CRISPR-Cas Systems"; Cell; vol. 168, 2 pages (Jan. 12, 2017).
Mohanraju, et al.; "Diverse evolutionary roots and mechanistic variations of the CRISPR-Cas systems"; Science; vol. 353, No. 6299, 14 pages (Aug. 5, 2016).
Hyun, et al.; "Site-directed mutagenesis in *Arabidopsis thaliana* using dividing tissue-targeted RGEN of the CRISPR/Cas system to generate heritable null alleles"; Planta; vol. 241, pp. 271-284 (Jan. 2015).
NCBI Accession No. KZX85786; 2 pages (May 2, 2016).
Xie et al.; "RNA-Guided Genome Editing in Plants Using a CRISPR-Cas System." Molecular Plant, vol. 6, No. 6 , pp. 1975-1983 (Nov. 2013).
Koonin, et al.; "Origins and evolution of CRISPR-Cas systems"; Phil. Trans. R. Soc. B.; vol. 374, No. 1772, 6 pages (Mar. 25, 2019).
Koonin, et al.; "CRISPR-Cas: an adaptive immunity system in prokaryotes"; F1000 Biology Reports; vol. 1, No. 95, 6 pages (Dec. 9, 2009).
Stella, et al.; "Class 2 CRISPR-Cas RNA-guided endonucleases: Swiss Army knives of genome editing"; Nature Structural & Molecular Biology; vol. 24, No. 11, pp. 882-892 (Nov. 2017).
East-Seletsky, et al.; "Two Distinct RNase Activities of CRISPR-C2c2 Enable Guide RNA Processing and RNA Detection"; Nature; vol. 538, No. 7624, pp. 270-273 (Sep. 26, 2016).
CLUSTL; "Omega Multiple Sequence Alignment. https://www.ebi.ac.uk/Tools/msa/clustalo/" [Retrieved from internet Feb. 2, 2022]. Alignment and Percent identity matrix. (Year: 2022).
NCBI Reference Sequence: WP_012985477.1 (May 18, 2013).
NCBI Reference Sequence: WP_015770004.1 (May 20, 2013).
NCBI Reference Sequence: WP_023911507.1 (Oct. 23, 2013).
NCBI Reference Sequence: WP_034560163.1 (Oct. 22, 2015).
GenBank CRL33181.1; Hypothetical protein T1815_05231 [[Eubacterium] rectale], priority to Apr. 6, 2016, 2 pages (Year: 2016).
NCBI Reference Sequence: WP_021746003.1 (Sep. 24, 2013).
NCBI Reference Sequence: WP_021746774.1 (Sep. 24, 2013).
NCBI Reference Sequence: WP_021747205.1 (Sep. 24, 2013).
Abudayyeh, et al.; "C2c2 is a single-component programmable RNA-guided RNA-targeting CRISPR effector"; Science; vol. 353, No. 6299, 23 pages (Aug. 5, 2016).

(56) References Cited

OTHER PUBLICATIONS

Abudayyeh, et al.; "C2c2 is a single-component programmable RNA-guided RNA-targeting CRISPR effector; Supplementary Information"; Science; vol. 353, vol. 6299, 31 pages (Aug. 5, 2016).
Abudayyeh, et al.; "RNA targeting with CRISPR-Cas13"; Nature; vol. 550, 18 pages (Oct. 12, 2017).
Ambion; "RnaseAlert Lab Test Kit v2, User Guide"; 12 pages (Mar. 1, 2013).
Anantharaman, et al.; "Thousands of microbial genomes shed light on interconnected biogeochemical processes in an aquifer system"; Nature Communications; vol. 7, No. 13210, 11 pages (Oct. 24, 2016).
Applied Biosystems/Ambion; "RNaseAlert Lab Test Kit"; 12 pages (2008).
Armitage, et al.; "Hairpin-Forming Peptide Nucleic Acid Oligomers"; Biochemistry; vol. 37, No. 26, pp. 9417-9425 (1998).
Baker, et al.; "Enigmatic, ultrasmall, uncultivated Archaea"; PNAS; vol. 107, No. 19, pp. 8806-8811 (May 11, 2010).
Barrangou, et al.; "Expanding the CRISPR Toolbox: Targeting RNA with Cas13b"; Molecular Cell; vol. 65, No. 4, pp. 582-584 (Feb. 16, 2017).
Bautista, et al.; "Virus-Induced Dormancy in the Archaeon Sulfolobus islandicus"; mBio; vol. 6, No. 2, 8 pages (2015).
Burstein, et al.; "New CRISPR-Cas systems from uncultivated microbes"; Nature; vol. 542, No. 7640, pp. 237-241 (Feb. 9, 2017).
Choudhury, et al.; "CRISPR-dCas9 mediated TET1 targeting for selective DNA demethylation at BRCA1 promoter"; Oncotarget; vol. 7, No. 29, pp. 46545-46556 (2016).
Chylinski, et al.; "Classification and evolution of type II CRISPR-Cas systems"; Nucleic Acids Research; vol. 42, No. 10, pp. 6091-6105 (2014).
Cong, et al.; "Multiplex Genome Engineering Using CRISPR/Cas Systems"; Science; vol. 339, No. 6121, pp. 819-823 (Feb. 15, 2013).
Cox, et al.; "RNA editing with CRISPR-Cas13"; Science; vol. 358, No. 6366, 15 pages (Nov. 24, 2017).
CRZ3554.1 (hypothetical protein HHT344_2368 [Herbinix hemicellulosilytica], Gen Bank Accession sequence, priority to Jul. 24, 2015, 1 page) (Year: 2015).
Deltcheva, et al.; "CRISPR RNA maturation by trans-encoded small RNA and host factor RNase III"; Nature; vol. 471, pp. 1-19 (Mar. 31, 2011).
East-Seletsky, et al.; "RNA Targeting by Functionally Orthogonal Type VI-A CRISPR-Cas Enzymes"; Molecular Cell; vol. 66, pp. 373-383 (May 4, 2017).
Fonfara, et al.; "Phylogeny of Cas9 determines functional exchangeability of dual-RNA and Cas9 among orthologous type II CRISPR-Cas systems"; Nucleic Acids Research; vol. 42, No. 4, pp. 2577-2590 (2014).
GenBank CRZ35554 1; "Hypothetical protein HHT355_2368 [Herbinix hemicellulosilytica]"; 1 page (Oct. 11, 2018).
GenBank OHA03494.1 (hypothetical protein A3J58_03210 [*Candidatus sung* bacteria bacterium RIFCSPH IGHO2_02_FULL_52_23], NCBI Reference Sequence, priority to Oct. 21, 2016, 2 pages) (Year: 2016).
Gootenberg, et al.; "Multiplexed and portable nucleic acid detection platform with Cas13, Cas12a, and Csm6"; Science; vol. 360, pp. 439-444 (2018).
Gootenberg, et al.; "Nucleic acid detection with CRISPR-Cas13a/C2c2"; Science; 9 pages (Apr. 13, 2017).
Hale, et al.; "RNA-Guided RNA Cleavage by a CRISPR RNA-Cas Protein Complex"; Cell; vol. 139, No. 5, pp. 945-956 (Nov. 25, 2009).
Hale, et al.; "Target RNA capture and cleavage by the Cmr type III-B CRISPR-Cas effector complex"; Genes & Development; vol. 28, No. 21, pp. 2432-2443 (Nov. 1, 2014).
Harrington, et al.; "Programmed DNA destruction by miniature CRISPR-Cas14 enzymes"; Science; vol. 362, pp. 839-842 (Nov. 16, 2018).
Hooton et al. "The Bacteriophage Carrier State of Campylobacter jejuni Features Changes in Host Non-coding RNAs and the Acquisition of New Host-derived CRISPR Spacer Sequences," Frontiers in Microbiology; vol. 7, Article 355, pp. 1-8 (Mar. 23, 2016).
Karvelis, et al.; "PAM recognition by miniature CRISPR-Cas12f nucleases triggers programmable double-stranded DNA target cleavage"; Nucleic Acids Research; pp. 1-8 (2020).
Kelemen, et al.; "Hypersensitive substrate for ribonucleases"; Nucleic Acids Research; vol. 27, No. 18, pp. 3696-3701 (1999).
Kim, et al.; "Specific and sensitive detection of nucleic acids and RNases using gold nanoparticle-RNA-fluorescent dye conjugates"; Chemical Communications; vol. 14, No. 42, pp. 4342-4344 (Sep. 19, 2007).
Knott, et al.; "Guide-bound structures of an RNA-targeting A-cleaving CRISPR-Cas13a enzyme"; Nature Structural & Molecular Biology; vol. 24, No. 10, 13 pages (Oct. 2017).
Kodak (Gel Logic 100 System User's Guide, 2005, 98 pages) (Year: 2005).
Koonin, et al.; "Diversity, classification and evolution of CRISPR-Cas systems"; Current Opinion in Microbiology; vol. 37, pp. 67-78 (2017).
Le Cong, et al.; "Multiplex Genome Engineering Using CRISPR/Cas Systems"; Science; vol. 339, pp. 819-823 (Feb. 15, 2013).
Li, et al.; "Using molecular beacons as a sensitive fluorescence assay for enzymatic cleavage of single-stranded DNA"; Nucleic Acids Research; vol. 28, No. 11, 6 pages (2000).
Liu, et al.; "CasX enzymes comprise a distinct family of RNA-guided genome editors"; Nature; vol. 566, pp. 23 pages (Feb. 14, 2019).
Liu, et al.; "The Molecular Architecture for RNA-Guided RNA Cleavage by Cas13a"; Cell; vol. 170, pp. 714-126 (Aug. 10, 2017).
Liu, et al.; "Two Distant Catalytic Sites Are Responsible for C2c2 RNase Activities"; Cell; vol. 168, pp. 121-134 (Jan. 12, 2017).
Makarova, et al.; "Evolutionary classification of CRISPR-Cas systems: a burst of class 2 and derived variants"; Nature Reviews Microbiology; vol. 18, pp. 67-83 (Feb. 2020).
Ngo, et al.; "Computational Complexity, Protein Structure Prediction, and the Levinthal Paradox"; The Protein Folding Problem and Tertiary Structure Prediction; pp. 433 and 492-495 (1994).
O'Connell; "Molecular Mechanisms of RNA Targeting by Cas13-containing Type VI CRISPR-Cas Systems"; J Mol Biol; vol. 431, pp. 66-87 (2019).
OHA03494.1 (hypothetical protein A3J58_03210 [*Candidatus sung* bacteria bacterium RIFCSPH IGHO2_02_FULL_52_23], NCBI Reference Sequence, priority to Oct. 21, 2016, 2 pages) (Year: 2016).
RNaseAlert Lab Test Kit (Applied Biosystems, Fluorometric RNase Detection Assay, 2008, 12 pages). (Year: 2008).
Sato, et al.; "Highly Sensitive Nuclease Assays Based on Chemically Modified DNA or RNA"; Sensors; vol. 14, No. 7, pp. 12437-12450 (2014).
Shmakov, et al.; "Discovery and functional characterization of diverse Class 2 CRISPR-Cas systems"; Mol. Cell.; vol. 60, No. 3, pp. 385-397 (Nov. 5, 2015).
Shmakov, et al.; "Diversity and evolution of class 2 CRISPR-Cas systems"; Nature Reviews Microbiology; vol. 15, pp. 169-182 (2017).
Smargon, et al.; "Cas13b is a Type VI-B CRISPR-associated RNA-Guided RNAse differentially regulated by accessory proteins Csx27 and Csx28"; Molecular Cell; vol. 65, No. 4, pp. 618-630 (Feb. 16, 2017).
Stephen Floor; "CV"; 6 pages (Jun. 11, 2018).
Stephen Floor; "Tweets cited in third party observation filed on Oct. 15, 2018"; 1 page (date of tweets are May 21, 2016).
Strauβ, et al.; "Zinc Fingers, TAL Effectors, or Cas9-Based DNA Binding Proteins: What's Best for Targeting Desired Genome Loci?"; Molecular Plant; vol. 6, No. 5, pp. 1384-1387 (Sep. 2013).
Third Party Observations filed on Oct. 15, 2018 in UK patent application No. GB 1804822.3 (18 pages).
Yan, et al.; "Cas13d Is a Compact RNA-Targeting Type VI CRISPR Effector Positively Modulated by a WYL-Domain-Containing Accessory Protein"; Molecular Cell; vol. 70, pp. 327-339 (2018).
Yang, et al.; "New CRISPR-Cas systems discovered"; Cell Res.; vol. 27, pp. 313-314 (Feb. 21, 2017).

(56) References Cited

OTHER PUBLICATIONS

Yang, et al.; "Using Molecular Beacons for Sensitive Fluorescence Assays of the Enzymatic Cleavage of Nucleic Acids"; Methods in Molecular Biology, Fluorescent Energy Transfer Nucleic Acid Probes: Designs and Protocols; vol. 335, pp. 71-81 (2006).

Zhang, et al.; "Design of a Molecular Beacon DNA Probe with Two Fluorophores"; Angew. Chem.; vol. 113, No. 2, pp. 416-419 (2001).

Karvelis, et al.; "PAM recognition by miniature CRISPR-Cas12f nucleases triggers programmable double-stranded DNA target cleavage"; Nucleic Acids Research; vol. 48, No. 9, pp. 5016-5023 (Apr. 4, 2020).

Shmakov, et al.; "Diversity and evolution of class 2 CRISPR-Cas systems"; Nature Review Microbiology; vol. 15, pp. 169-182 (Mar. 2017).

Chen, et al.; "CRISPR-Cas12a target binding unleashes indiscriminate single-stranded DNase activity"; Science; vol. 360, pp. 436-439 (2018).

Liu, et al.; "Delivery strategies of the CRISPR-Cas9 gene-editing system for therapeutic applications"; Journal of Controlled Release; vol. 266, pp. 17-26 (2017).

Makarova, et al.; "An updated evolutionary classification of CRISPR-Cas systems"; Nat. Rev. Microbiol.; vol. 13, No. 11, pp. 722-736 (Nov. 2015).

Price, et al.; "Cas9-mediated targeting of viral RNA in eukaryotic cells"; PNAS; vol. 112, No. 19, pp. 6164-6169 (May 12, 2015).

Sampson, et al.; "A CRISPR/Cas system mediates bacterial innate immune evasion and virulence"; Nature; vol. 497, No. 7448; pp. 254-257 (May 9, 2013).

Wright, et al.; "Biology and Applications of CRISPR Systems: Harnessing Nature's Toolbox for Genome Engineering"; Cell; vol. 164, pp. 29-44 (2016).

Yamano, et al.; "Crystal Structure of Cpf1 in Complex with Guide RNA and Target DNA"; Cell; vol. 165, pp. 949-962 (2016).

Zetsche, et al.; "Cpf1 Is a Single RNA-Guided Endonuclease of a Class 2 CRISPR-Cas System"; Cell; vol. 163, pp. 759-771 (Oct. 22, 2015).

GenBank U2UMQ6; "Rec Name: Full=CRISPR-associated endonuclease Cas12a; AltName: Full=AsCpf1; AltName: Full=CRISPR-associated endonuclease Cpf1"; 11 pages (Jun. 2023).

Wright, et al.; "Rational design of a split-Cas9 enzyme complex"; PNAS; vol. 112, No. 10, pp. 2984-2989 (Mar. 10, 2015).

\* cited by examiner

FIG. 1

>CasY1
MRKKLFKGYILHNKRLVYTGKAAIRSIKYPLVAPNKTALNNLSEKIIYDYEHLFGPLNVA
SYARNSNRYSLVDFWIDSLRAGVIWQSKSTSLIDLISKLEGSKSPSEKIFEQIDFELKNK
LDKEQFKDIILLNTGIRSSSNVRSLRGRFLKCFKEEFRDTEEVIACVDKWSKDLIVEGKS
ILVSKQFLYWEEEFGIKIFPHFKDNHDLPKLTFFVEPSLEFSPHLPLANCLERLKKFDIS
RESLLGLDNNFSAFSNYFNELFNLLSRGEIKKIVTAVLAVSKSWENEPELEKRLHFLSEK
AKLLGYPKLTSSWADYRMIIGGKIKSWHSNYTEQLIKVREDLKKHQIALDKLQEDLKKVV
DSSLREQIEAQREALLPLLDTMLKEKDFSDDLELYRFILSDFKSLLNGSYQRYIQTEEER
KEDRDVTKKYKDLYSNLRNIPRFFGESKKEQFNKFINKSLPTIDVGLKILEDIRNALETV
SVRKPPSITEEYVTKQLEKLSRKYKINAFNSNRFKQITEQVLRKYNNGELPKISEVFYRY
PRESHVAIRILPVKISNPRKDISYLLDKYQISPDWKNSNPGEVVDLIEIYKLTLGWLLSC
NKDFSMDFSSYDLKLFPEAASLIKNFGSCLSGYYLSKMIFNCITSEIKGMITLYTRDKFV
VRYVTQMIGSNQKFPLLCLVGEKQTKNFSRNWGVLIEEKGDLGEEKNQEKCLIFKDKTDF
AKAKEVEIFKNNIWRIRTSKYQIQFLNRLFKKTKEWDLMNLVLSEPSLVLEEEWGVSWDK
DKLLPLLKKEKSCEERLYYSLPLNLVPATDYKEQSAEIEQRNTYLGLDVGEFGVAYAVVR
IVRDRIELLSWGFLKDPALRKIRERVQDMKKKQVMAVFSSSSTAVARVREMAIHSLRNQI
HSIALAYKAKIIYEISISNFETGGNRMAKIYRSIKVSDVYRESGADTLVSEMIWGKKNKQ
MGNHISSYATSYTCCNCARTPFELVIDNDKEYEKGGDEFIFNVGDEKKVRGFLQKSLLGK
TIKGKEVLKSIKEYARPPIREVLLEGEDVEQLLKRRGNSYIYRCPFCGYKTDADIQAALN
IACRGYISDNAKDAVKEGERKLDYILEVRKLWEKNGAVLRSAKFL (SEQ ID NO: 1)

>CasY2
MQKVRKTLSEVHKNPYGTKVRNAKTGYSLQIERLSYTGKEGMRSFKIPLENKNKEVFDEF
VKKIRNDYISQVGLLNLSDWYEHYQEKQEHYSLADFWLDSLRAGVIFAHKETEIKNLISK
IRGDKSIVDKFNASIKKKHADLYALVDIKALYDFLTSDARRGLKTEEEFFNSKRNTLFPK
FRKKDNKAVDLWVKKFIGLDNKDKLNFTKKFIGFDPNPQIKYDHTFFFHQDINFDLERIT
TPKELISTYKKFLGKNKDLYGSDETTEDQLKMVLGFHNNHGAFSKYFNASLEAFRGRDNS
LVEQIINNSPYWNSHRKELEKRIIFLQVQSKKIKETELGKPHEYLASFGGKFESWVSNYL
RQEEEVKRQLFGYEENKKGQKKFIVGNQELDKIIRGTDEYEIKAISKETIGLTQKCLKL
LEQLKDSVDDYTLSLYRQLIVELRIRLNVEFQETYPELIGKSEKDKEKDAKNKRADKRYP
QIFKDIKLIPNFLGETKQMVYKKFIRSADILYEGINFIDQIDKQITQNLLPCFKNDKERI
EFTEKQFETLRRKYYLMNSSRFHHVIEGIINNRKLIEMKKRENSELKTFSDSKFVLSKLF
LKKGKKYENEVYYTFYINPKARDQRRIKIVLDINGNNSVGILQDLVQKLKPKWDDIIKKN
DMGELIDAIEIEKVRLGILIALYCEHKFKIKKELLSLDLFASAYQYLELEDDPEELSGTN
LGRFLQSLVCSEIKGAINKISRTEYIERYTVQPMNTEKNYPLLINKEGKATWHIAAKDDL
SKKKGGGTVAMNQKIGKNFFGKQDYKTVFMLQDKRFDLLTSKYHLQFLSKTLDTGGGSWW
KNKNIDLNLSSYSFIFEQKVKVEWDLTNLDHPIKIKPSENSDDRRLFVSIPFVIKPKQTK
RKDLQTRVNYMGIDIGEYGLAWTIINIDLKNKKINKISKQGFIYEPLTHKVRDYVATIKD
NQVRGTFGMPDTKLARLRENAITSLRNQVHDIAMRYDAKPVYEFEISNFETGSNKVKVIY
DSVKRADIGRGQNNTEADNTEVNLVWGKTSKQFGSQIGAYATSYICSFCGYSPYYEFENS
KSGDEEGARDNLYQMKKLSRPSLEDFLQGNPVYKTFRDFDKYKNDQRLQKTGDKDGEWKT
HRGNTAIYACQKCRHISDADIQASYWIALKQVVRDFYKDKEMDGDLIQGDNKDKRKVNEL
NRLIGVHKDVPIINKNLITSLDINLL (SEQ ID NO: 2)

FIG. 1 (Cont.)

```
>CasY3
MKAKKSFYNQKRKFGKRGYRLHDERIAYSGGIGSMRSIKYELKDSYGIAGLRNR
IADATISDNKWLYGNINLNDYLEWRSSKTDKQIEDGDRESSLLGFWLEALRLGFVFSKQS
HAPNDFNETALQDLFETLDDDLKHVLDRKKWCDFIKIGTPKTNDQGRLKKQIKNLLKGNK
REEIEKTLNESDDELKEKINRIADVFAKNKSDKYTIFKLDKPNTEKYPRINDVQVAFFCH
PDFEEITERDRTKTLDLIINRFNKRYEITENKKDDKTSNRMALYSLNQGYIPRVLNDLFL
FVKDNEDDFSQFLSDLENFFSFSNEQIKIIKERLKKLKKYAEPIPGKPQLADKWDDYASD
FGGKLESWYSNRIEKLKKIPESVSDLRNNLEKIRNVLKKQNNASKILELSQKIIEYIRDY
GVSFEKPEIIKFSWINKTKDGQKKVFYVAKMADREFIEKLDLWMADLRSQLNEYNQDNKV
SFKKKGKKIEELGVLDFALNKAKKNKSTKNENGWQQKLSESIQSAPLFFGEGNRVRNEEV
YNLKDLLFSEIKNVENILMSSEAEDLKNIKIEYKEDGAKKGNYVLNVLARFYARFNEDGY
GGWNKVKTVLENIAREAGTDFSKYGNNNNRNAGRFYLNGRERQVFTLIKFEKSITVEKIL
ELVKLPSLLDEAYRDLVNENKNHKLRDVIQLSKTIMALVLSHSDKEKQIGGNYIHSKLSG
YNALISKRDFISRYSVQTTNGTQCKLAIGKGKSKKGNEIDRYFYAFQFFKNDDSKINLKV
IKNNSHKNIDFNDNENKINALQVYSSNYQIQFLDWFFEKHQGKKTSLEVGGSFTIAEKSL
TIDWSGSNPRVGFKRSDTEEKRVFVSQPFTLIPDDEDKERRKERMIKTKNRFIGIDIGEY
GLAWSLIEVDNGDKNNRGIRQLESGFITDNQQQVLKKNVKSWRQNQIRQTFTSPDTKIAR
LRESLIGSYKNQLESLMVAKKANLSFEYEVSGFEVGGKRVAKIYDSIKRGSVRKKDNNSQ
NDQSWGKKGINEWSFETTAAGTSQFCTHCKRWSSLAIVDIEEYELKDYNDNLFKVKINDG
EVRLLGKKGWRSGEKIKGKELFGPVKDAMRPNVDGLGMKIVKRKYLKLDLRDWVSRYGNM
AIFICPYVDCHHISHADKQAAFNIAV   (SEQ ID NO: 3)

>CasY4
MSKRHPRISGVKGYRLHAQRLEYTGKSGAMRTIKYPLYSSPSGGRTVPREIVSAINDDYV
GLYGLSNFDDLYNAEKRNEEKVYSVLDFWYDCVQYGAVFSYTAPGLLKNVAEVRGGSYEL
TKTLKGSHLYDELQIDKVIKFLNKKEISRANGSLDKLKKDIIDCFKAEYRERHKDQCNKL
ADDIKNAKKDAGASLGERQKKLFRDFFGISEQSENDKPSFTNPLNLTCCLLPFDTVNNNR
NRGEVLFNKLKEYAQKLDKNEGSLEMWEYIGIGNSGTAFSNFLGEGFLGRLRENKITELK
KAMMDITDAWRGQEQEEELEKRLRILAALTIKLREPKFDNHWGGYRSDINGKLSSWLQNY
INQTVKIKEDLKGHKKDLKKAKEMINRFGESDTKEEAVVSSLLESIEKIVPDDSADDEKP
DIPAIAIYRRFLSDGRLTLNRFVQREDVQEALIKERLEAEKKKKPKKRKKKSDAEDEKET
IDFKELFPHLAKPLKLVPNFYGDSKRELYKKYKNAAIYTDALWKAVEKIYKSAFSSSLKN
SFFDTDFDKDFFIKRLQKIFSVYRRFNTDKWKPIVKNSFAPYCDIVSLAENEVLYKPKQS
RSRKSAAIDKNRVRLPSTENIAKAGIALARELSVAGFDWKDLLKKEEHEEYIDLIELHKT
ALALLLAVTETQLDISALDFVENGTVKDFMKTRDGNLVLEGRFLEMFSQSIVFSELRGLA
GLMSRKEFITRSAIQTMNGKQAELLYIPHEFQSAKITTPKEMSRAFLDLAPAEFATSLEP
ESLSEKSLLKLQMRYYPHYFGYELTRTGQGIDGGVAENALRLEKSPVKKREIKCKQYKT
LGRGQNKIVLYVRSSYYQTQFLEWFLHRPKNVQTDVAVSGSFLIDEKKVKTRWNYDALTV
ALEPVSGSERVFVSQPFTIFPEKSAEEEGQRYLGIDIGEYGIAYTALEITGDSAKILDQN
FISDPQLKTLREEVKGLKLDQRRGTFAMPSTKIARIRESLVHSLRNRIHHLALKHKAKIV
YELEVSRFEEGKQKIKKVYATLKKADVYSEIDADKNLQTTVWGKLAVASEISASYTSQFC
GACKKLWRAEMQVDETITTQELIGTVRVIKGGTLIDAIKDFMRPPIFDENDTPFPKYRDF
CDKHHISKKMRGNSCLFICPFCRANADADIQASQTIALLRYVKEEKKVEDYFERFRKLKN
IKVLGQMKKI   (SEQ ID NO: 4)
```

FIG. 1 (Cont.)

>CasY5
MAESKQMQCRKCGASMKYEVIGLGKKSCRYMCPDCGNHTSARKIQNKKKRD
KKYGSASKAQSQRIAVAGALYPDKKVQTIKTYKYPADLNGEVHDSGVAEKIAQAIQEDEI
GLLGPSSEYACWIASQKQSEPYSVVDFWFDAVCAGGVFAYSGARLLSTVLQLSGEESVLR
AALASSPFVDDINLAQAEKFLAVSRRTGQDKLGKRIGECFAEGRLEALGIKDRMREFVQA
IDVAQTAGQRFAAKLKIFGISQMPEAKQWNNDSGLTVCILPDYYVPEENRADQLVVLRR
LREIAYCMGIEDEAGFEHLGIDPGALSNFSNGNPKRGFLGRLLNNDIIALANNMSAMTPY
WEGRKGELIERLAWLKHRAEGLYLKEPHFGNSWADHRSRIFSRIAGWLSGCAGKLKIAKD
QISGVRTDLFLLKRLLDAVPQSAPSPDFIASISALDRFLEAAESSQDPAEQVRALYAFHL
NAPAVRSIANKAVQRSDSQEWLIKELDAVDHLEFNKAFPFFSDTGKKKKKGANSNGAPSE
EEYTETESIQQPEDAEQEVNGQEGNGASKNQKKFQRIPRFFGEGSRSEYRILTEAPQYFD
MFCNNMRAIFMQLESQPRKAPRDFKCFLQNRLQKLYKQTFLNARSNKCRALLESVLISWG
EFYTYGANEKKFRLRHEASERSSDPDYVVQQALEIARRLFLFGFEWRDCSAGERVDLVEI
HKKAISFLLAITQAEVSVGSYNWLGNSTVSRYLSVAGTDTLYGTQLEEFLNATVLSQMRG
LAIRLSSQELKDGFDVQLESSCQDNLQHLLVYRASRDLAACKRATCPAELDPKILVLPVG
AFIASVMKMIERGDEPLAGAYLRHRPHSFGWQIRVRGVAEVGMDQGTALAFQKPTESEPF
KIKPFSAQYGPVLWLNSSSYSQSQYLDGFLSQPKNWSMRVLPQAGSVRVEQRVALIWNLQ
AGKMRLERSGARAFFMPVPFSFRPSGSGDEAVLAPNRYLGLFPHSGGIEYAVVDVLDSAG
FKILERGTIAVNGFSQKRGERQEEAHREKQRRGISDIGRKKPVQAEVDAANELHRKYTDV
ATRLGCRIVVQWAPQPKPGTAPTAQTVYARAVRTEAPRSGNQEDHARMKSSWGYTWGTYW
EKRKPEDILGISTQVYWTGGIGESCPAVAVALLGHIRATSTQTEWEKEEVVFGRLKKFFP
S      (SEQ ID NO: 6)

>CasY6
MAESKQMQCRKCGASMKYEVIGLGKKSCRYMCPDCGNHTSARKIQNKKKRD
KKYGSASKAQSQRIAVAGALYPDKKVQTIKTYKYPADLNGEVHDRGVAEKIEQAIQEDEI
GLLGPSSEYACWIASQKQSEPYSVVDFWFDAVCAGGVFAYSGARLLSTVLQLSGEESVLR
AALASSPFVDDINLAQAEKFLAVSRRTGQDKLGKRIGECFAEGRLEALGIKDRMREFVQA
IDVAQTAGQRFAAKLKIFGISQMPEAKQWNNDSGLTVCILPDYYVPEENRADQLVVLRR
LREIAYCMGIEDEAGFEHLGIDPGALSNFSNGNPKRGFLGRLLNNDIIALANNMSAMTPY
WEGRKGELIERLAWLKHRAEGLYLKEPHFGNSWADHRSRIFSRIAGWLSGCAGKLKIAKD
QISGVRTDLFLLKRLLDAVPQSAPSPDFIASISALDRFLEAAESSQDPAEQVRALYAFHL
NAPAVRSIANKAVQRSDSQEWLIKELDAVDHLEFNKAFPFFSDTGKKKKKGANSNGAPSE
EEYTETESIQQPEDAEQEVNGQEGNGASKNQKKFQRIPRFFGEGSRSEYRILTEAPQYFD
MFCNNMRAIFMQLESQPRKAPRDFKCFLQNRLQKLYKQTFLNARSNKCRALLESVLISWG
EFYTYGANEKKFRLRHEASERSSDPDYVVQQALEIARRLFLFGFEWRDCSAGERVDLVEI
HKKAISFLLAITQAEVSVGSYNWLGNSTVSRYLSVAGTDTLYGTQLEEFLNATVLSQMRG
LAIRLSSQELKDGFDVQLESSCQDNLQHLLVYRASRDLAACKRATCPAELDPKILVLPAG
AFIASVMKMIERGDEPLAGAYLRHRPHSFGWQIRVRGVAEVGMDQGTALAFQKPTESEPF
KIKPFSAQYGPVLWLNSSSYSQSQYLDGFLSQPKNWSMRVLPQAGSVRVEQRVALIWNLQ
AGKMRLERSGARAFFMPVPFSFRPSGSGDEAVLAPNRYLGLFPHSGGIEYAVVDVLDSAG
FKILERGTIAVNGFSQKRGERQEEAHREKQRRGISDIGRKKPVQAEVDAANELHRKYTDV
ATRLGCRIVVQWAPQPKPGTAPTAQTVYARAVRTEAPRSGNQEDHARMKSSWGYTWSTYW
EKRKPEDILGISTQVYWTGGIGESCPAVAVALLGHIRATSTQTEWEKEEVVFGRLKKFFP
S      (SEQ ID NO: 7)

FIG. 1 (Cont.)

>CasY7
MKRILNSLKVAALRLLFRGKGSELVKTVKYPLVSPVQGAVEELAEAIRHDNLHLFGQKEI
VDLMEKDEGTQVYSVVDFWLDTLRLGMFFSPSANALKITLGKFNSDQVSPFRKVLEQSPF
FLAGRLKVEPAERILSVEIRKIGKRENRVENYAADVETCFIGQLSSDEKQSIQKLANDIW
DSKDHEEQRMLKADFFAIPLIKDPKAVTEEDPENETAGKQKPLELCVCLVPELYTRGFGS
IADFLVQRLTLLRDKMSTDTAEDCLEYVGIEEEKGNGMNSLLGTFLKNLQGDGFEQIFQF
MLGSYVGWQGKEDVLRERLDLLAEKVKRLPKPKFAGEWSGHRMFLHGQLKSWSSNFFRLF
NETRELLESIKSDIQHATMLISYVEEKGGYHPQLLSQYRKLMEQLPALRTKVLDPEIEMT
HMSEAVRSYIMIHKSVAGFLPDLLESLDRDKDREFLLSIFPRIPKIDKKTKEIVAWELPG
EPEEGYLFTANNLFRNFLENPKHVPRFMAERIPEDWTRLRSAPVWFDGMVKQWQKVVNQL
VESPGALYQFNESFLRQRLQAMLTVYKRDLQTEKFLKLLADVCRPLVDFFGLGGNDIIFK
SCQDPRKQWQTVIPLSVPADVYTACEGLAIRLRETLGFEWKNLKGHEREDFLRLHQLLGN
LLFWIRDAKLVVKLEDWMNNPCVQEYVEARKAIDLPLEIFGFEVPIFLNGYLFSELRQLE
LLLRRKSVMTSYSVKTTGSPNRLFQLVYLPLNPSDPEKKNSNNFQERLDTPTGLSRRFLD
LTLDAFAGKLLTDPVTQELKTMAGFYDHLFGFKLPCKLAAMSNHPGSSSKMVVLAKPKKG
VASNIGFEPIPDPAHPVFRVRSSWPELKYLEGLLYLPEDTPLTIELAETSVSCQSVSSVA
FDLKNLTTILGRVGEFRVTADQPFKLTPIIPEKEESFIGKTYLGLDAGERSGVGFAIVTV
DGDGYEVQRLGVHEDTQLMALQQVASKSLKEPVFQPLRKGTFRQQERIRKSLRGCYWNFY
HALMIKYRAKVVHEESVGSSGLVGQWLRAFQKDLKKADVLPKKGGKNGVDKKKRESSAQD
TLWGGAFSKKEEQQIAFEVQAAGSSQFCLKCGWWFQLGMREVNRVQESGVVLDWNRSIVT
FLIESSGEKVYGFSPQQLEKGFRPDIETFKKMVRDFMRPPMFDRKGRPAAAYERFVLGRR
HRRYRFDKVFEERFGRSALFICPRVGCGNFDHSSEQSAVVLALIGYIADKEGMSGKKLVY
VRLAELMAEWKLKKLERSRVEEQSSAQ    (SEQ ID NO: 5)

>CasY18
MKRIAKFRHDKPVKREAWSKGYRVHKNRIINKVTRSIKYPLVVKDEWKKRLIDDAAHDYRWLVG
PINYSDWCRDPNQYSILEFWIDFLCVGGVFQSSHSNICRLAIQLSGGSVFEQEWKDLSPFVRAN
LIQGIKPAEFIGFLTAEFRSSSNPKNFISKFFEGSNEDLESLTNEFASIVDFIKAKDISLLRKS
LPSCKKIAPNLWEKAVGSHSTNELLKLLTKYTRVMLVAEPSHSDRVFSQTVLQSNDQDDPELTG
PLPSHKVGKASYLFIPEFIREVNLDKISKLDLSAKSKLAVEQVKKLSELTSDFKQIENQSEAYF
GLSTSFNELSNFLGILIRTLRNAPEAILKDQIALCAPLDKDILKITLDWLCDRAQALPENPRFE
TNWAEYRSYLGGKIKSWFSNYENFFEIPQAASSQQNNNREKKLGNRSAIRALNLKKEAFEKARE
TFKGDKGTLEKIDLAYRLLGSISPEVLQCDEGLKLYQQFNDELLVLNETINQKFQDAKRDIKAK
KEKESFEKLQRNLSSPLPRIPEFFGERAKKGYQKARVSPKLARHLLECLNDWLARFAKVEESAF
SEKEFQRILDWLRTSDFLPVFIRKSKDPPSWLRYIARVATGKYYFWVSEYSRKRVQIIDKPIAQ
NPLKELISWFLLNKDAFSRDNELFKGLSSKMVTLARIMAGILRDRGEGLKELQAMTSKLDNIGL
LHPSFSVPVTDSLKDAAFYRAFFSELEGLLNIGRSRLIIERITLQSQQSKNKKTRRPLMPEPFI
NEDKEVFLAFPKFETKNKVKGTRVVYNSPDEVNWLLSPIRSSKGQLSFMFRCLSEDAKIMTTSG
GCSYIVEFKKLLEAQEEVLSIHDCDIIPRAFVSIPFTLERESEETKPDWKPNRFMGVDIGEYAV
AYCVIEKGTDSIEILDCGIVRNGAHRVLKEKVDRLKRRQRSMTFGAMDTSIAAARESLVGNYRN
RLHAIALKHGAKLVYEYEVSAFESGGNRIKKVYETLKKSDCTGETEADKNARKHIWGETNAVGD
QIGAWTSQTCAKCGRSFGADLKAGNFGVAVPVPEKVEDSKGHYAYHEFPFEDGLKVRGFLKPN
KIISDQKELAKAVHAYMRPPLVALGKRKLPKNARYRRGNSSLFRCPFSDCGFTADADIQAAYNI
AVKQLYKPKKGYPKERKWQDFVILKPKEPSKLFDKQFYRPN    (SEQ ID NO: 8)

FIG. 1 (Cont.)

```
>CasY9
mdkkitgyrlhfkrilfsggeivrtikfplsststslssgkndlinnfegqlinddlkirgd
vnlndyliyefsgkpiytlfnfwidslksgiiwadkpaslidfinefylikspydlvwer
ateefkkyfdkksfkeilisgpirktknpskkesfkkkdnklpdeyvikegnslsvespe
vlkfinkivssffdedgnlilegkkqdnfwlnefgidksiiqktkpegelkditfviipe
livdsfnkeyevdsliekrrvwlkkrfnkekeieknlqlilglsnnfngfsnflgkglra
fqggkilmifeamskinpsiknqenkekvlealnflsdkskffplrpslnivkswadyrt
ffggklqswysngirrknelkvqvkeiyefltkaqdylaakisfndenkryarkelesin
lkinrlkqfienenfdissedrylifdtllsslrtqlnlyyqkylsseednirenkdlkg
iyqkiykpiaffgkatkrknkkvieetvpiiesginnlfslmkklektflpkntfskvkn
knedeetnlrnlvdyyqnkvshkmlnsltfvnkleevmksvieendwdklhsnkyvfyks
eyqkgaleliplkkgswidifekiilemtsylltfdltdllkdkkilldwieiakntlak
likfntcdvftldelnldlrnfpkamdyikifkitkvdknelnfivqsfilselkgaatl
fskekylakynvqvinadkkfklfykpndgfierevdrknllkphqyfvaldkiedkkik
ekanfllitkedikpvfikeenfsklykisssfyqiqfldkfiympeefkdlgirlsewn
fvlereykidwdlctkrpkmtfiensknklylsipfnvfykskkkdvslskvisnrlsy
pilgidvgeyglayllaefsdkkikilkkgfiedrnianikdkfaeiqlkartgifneed
ttiarvrenaignlrnkvhyiltsdrgasiiyersisnfetgsgrttkiydsvkradtef
eteadkfihnhvwgkntkyvgrslsaygssyicskchrsiyqfkkedlreikllmregni
ltfltpigkvwgyskdekfkkdyqfkptekdfkefikilkdfarppvgknktevlekffl
kdndkkakidefrkkrgasaificpfcgfiadadiqaafvmavrgyirfkesqikeenks
lilektinylkevqfkpediflpf (SEQ ID NO: 51)

>CasY10
mkdskinapininannvsknktpkkkprrksgkrgyrlhderiaysggtgscrsikyell
npdatrknllrgsglqheiisavrqdnlllygplnfndyifdkdapnllhfwtlalslgf
vfsnqnsierefkdylgvsteeavlfgklnetlkavfdeakfisgflymfrglasktre
qriklltdtlrepldgvngdsvseiikpyaekwaeydgecdqfvfkcelfsikstdkpre
ntrlsfaidpafevmklddktvffddlithykencsdeaqakrflgigdngnyfngifgg
lfelltdgdekicettdhlariygfdetkkteinkrlvrlaeyarqinrrpclvkrwsey
rsdfngtieswysnrqskqndtlkqldeklklleemrasfptdsdlcgikslsetiefir
slkgeriarkvtdelesylavlgselnqytqqnkdhalplgwqkklskhiqssplffgen
kialwekliniLkeliktevkelevvlaedfddyeitdkqvdnlaalagrfsespdgsghp
lvterlakiestlgvdfthknnrakfylsgfergkfgkldvpnkikvshlfeladlsily
navanspedgyilrdtaqlskiilsaklrdadrekqrktvlahstlqgysaliskrefvs
ryplqavngsqnlmaydanrkyyyaynsekfagtkeltvalrgnnfgpeafggkfkkvpa
lrvqsskyqiqfldwffekqkkrktelgaggsftiaeisckvnwddktpvifekpdprlf
vsqpftinppensakkdyaryigidigeyglawhlvevfedanediggagknavriksve
kgfftdpqqislkedvkklrenqvratftspdtkiarvresligsyrnlledlavrkdar
lcfeyevsgfesggariskvydsikrssvakkenkaenkqswgklfgpefsfkaieitaa
gtsqyctkckrwaslaikdnnnyqllewdngetgdkrgsdgllavtldgegketnrtvrl
fpkdgkkagdtikgkdlksaiyramrpnmrpsedgsislgagmeavrrdlmpeqwekltl
efgqgkprgnmaiyvcpycghisdadmqaafniavrgylanrdkekkvklgkeyltdeqs
kltfdpvgilehtt (SEQ ID NO: 52)
```

FIG. 1 (Cont.)

>CasY11
mfnqkkgyrlhleriiysggeitrsikyllashsdsqknkellnnfsqdlynddlkirgclnln
dlvnnnqiynladfwidslragviwqssasslidfikrlnhqetigekifnnanerikrffnse
kfikeiilsepkrisskkqafynslfdilkdefkkqeknekiiidnkaeqlikeivdafysndg
vflmegeekqnnfwqekfnidknmikkekedilkdvgditafihppliilkgdvsqliderkky
fsekdleeilglsdnfnafshyfnkffllyqdkqekifecyqkifsfsqedrkrikdaldfll
ekskllglpkivnswsdyrsvfggkikswfsnylnredkakkqekkikeglekvnkflldfiqk
nqvdsdlqqeikfyydklnqfinsyqnqeffhqqelfllfsdllaeyreklnrfyqkylsdkek
eekkvdefplfkdlfekyegpisfygktklednkkiidltfktikvglnlirrllidlynssdf
knsdnnnqerdlrrifefllnkipatktfrekylsilkdnfdqqtykemtlkpsrytfveniys
renrklielpsknfeellskiikdltdfslsfknddlfvdiyllsdlvelaktlislvinysnk
sqfdsykneliddtyqkakkyletfkisffnskkeanyfyqtrvlselkgavalfskkyyqaky
niqilksneifplfvkfsdllkkeeindinklklifkkpyrylialkkikfkkkqqqssvihld
kknkdlvlispqdedflfkltssfyqlqfldrfvypvkkwlnvditlsewsfilekkykinwdf
nngkpefseidsrlylnipfkikainqqkilkpkelflgidvgeygvqyalvnfkdeeikiiks
gfirsskniasirdkyrllqdrskkgvyfsstnvvqevrenaigeirnqihdiliknnadliyey
nisnfetgsgritkiydsikksdvyaeneadksviqhvwgikksiashlsaygssytcsncgrs
ifsfsendifssskvikrdgniitiqtpkgevfayskdkkfnigysfsqeknkeemknlfmkivk
ayarppllksevlltqkkldreflekfkkergnsaifvcpfvdcqsladsdiqaafimalrgyl
kkkkgkdinyleeslnylqnfkgkinfsnllh (SEQ ID NO: 53)

>CasY12
mnkkssnstgyrlhkdrilfsggeimrtikyplvveknnlnseeivekirqaiinddrvirsdi
nlndyieytkkgnrlytlidfwqdclragviwqpstsfllylinklyskpkaielienakpdis
rffdvdkfskcfilpgeiregkilktfkrelieaalkgefkkgkkekikdeddylekfvekdark
lireiadcffsndilvthdlkegkkeyqdrlweekfgikkgkllenfklpdhlrnfknisffii
pelsdksknfdelielrrkwllerkicvredgdylenekkldeelrnlvglsdncnplsnflgt
vfcellvpnnlnednalekfydvftivepkiaelnikdqimgsleflrlrakqlgspnlvnfsk
sqnlkanesikldgwslyrqnfgskmqswftsyiernklledslknfkekikkaqnfiknlkni
seepqqeeeaqqekeeivelfekifsslekvnrenfevfdsllsslrkrlnffyqqylyneake
gddvkkhkilgpifkniekpiafygetqrkknekfvedtipileegtvflttlisnlldsfspk
qvfpdvrkkdeteeiiyrkelqffwnklkdlavnskefekeyqdiiesavdeselsklkelfvn
kkkngskynkytfykskytkgsieeiklkgskeeyllrfekliksltnfltqfnrnkllqdkdl
lldwvelakniivsvlirfstntefslneikaqsqfkkaknylelfklkkakkkefgfiiqsfil
seikgaatlyskrkyiasysvqivgsnnkfklfyqpldssinisggpkdfvtkkhkylivfqdl
knvknkdatenrinllrlnkerkiplvaykddlvskslllssspyqlqfldkylyrprgwenid
iklnewsfvveeaydiewdlnsktpklipspksnrnklylaipftlkgnvkeppldkivlkset
kkdhsrdknrlnypilgvdvgeygvawcltkfdynqdfslrdidiqgkgfiedrnigkikdyfa
eiqqksrkgaydeddttiakvrenaigklrnaihsiltgslegaspvyedaisnfetgsgktik
iynsvkradtefkseadkaehslvwgkkdrnqetkyigrnvsayassytcvnclhtlfkvkked
lsnikilekdgrivtmsspygpdkkvrgylsekekyeigyqfkeseedlkafrkivrdfarppv
nknsevlekyakeilagnkieefrkkrgnsaifvcpfcqfkadadiqaafmmamrgylrfsgiv
pskensknnpqesedkslknskkqsetgdtfltktaeylqqlrfeikekikeavkvdf
(SEQ ID NO: 54)

FIG. 1 (Cont.)

>CasY13
mtkrksrlagyrlhkerilfaggqiirtikypltpsypteemtqflkdfeeaviaddlkirgdl
nindyltytakgkplytlfdfwvdslrngviwmskgtmlidflatqyninspfdnvwkkaspri
tsffkkdefkeiilcdpvrssstknsfhkritgylkdhlkvkngdsytivsndaqkvvefivhs
ffnnegklilegeeqfkfwkkeynldkaiiesakpkgkyaditfviipelisnlnpkqsledli
nkrdvwlqgrrfdkedklllsilglsdnfngfsnflgvvlrdlqkengnkevlydaqktvfpll
gnskdevlealdflsqkakllgvtslplvngwheyrsifggklkswftnsqnrkeeldgqisrf
keslfkarnylqtenfgeeankekedilsflsllenfftdekrsikveenyqlfepllalvkrr
lnffyqryiqkegdetkvnelghfkglyekiykpvafygyaakkvnkkfvnqtfpiledgieni
eklisylqnsfsvqetfeevkqgkeeiddpyrkllqffwnkyledsinshlfaekykdilkgni
ednewekvidktkkgkyvfykspyakgsleeipigtsnyleqlqisilelskfilsykkdills
dvglIldwvelsknvisillrfntkktyriddlrldnfsqakryqelfkhgdypknefsfiiqs
lvlseirgaatlyskreyiasysvqvvqsdskyriyyipkekisitpdvvksrpesserkqlmg
phyyavalgkvlekkkseifnsialfkknikaiflpesslrgvfrlssspyqlqfldkfiyrpf
gwenidvslsewsfivekrytinwdlrskkpkllpvtdteriknkvyiaipfnlipskevrqa
aplktiakgketrekdlsrlnfpimgvdvgeyglayclvkiifdkntykilaielvsdkkeafg
fiedrnignikdkfaeiqhrarqgsfdeedtvitrvrenavghlrnrlhvivtlqrsssvyeds
isnfetgsgrttkiynsvkradtesdtnadkmthnhvwgektkwvgrnvsayassytcvsclks
lyqvrkedlskmritqrggrivtisqphgdikgyvskeekynlgyhfretddelknfrkivqdf
arppvgdhsevlkkyakqilekgkieewrkrrgnssificpfcqyitdadvqaafmmairgylr
fsgivpsrgnkkdqdqeqedektagesfleqtqrqlgdvnlskileafslki
    (SEQ ID NO: 55)

>CasY14
mvfpamlfytrpeyafltilislessvlflpkkiivmtaktqknknskktkhfgqtgyalhksr
lvytgkeairsikfplkstsqvklddfankvisdysliqgatnineylteyqnaqhsyslidfw
vdslragvvfaktpaaltdflhvvyqrtspsrlafdqmykslrskldyelflqkiilstgirks
agkhgilscfkkewqsdpsvlkevdyifsnlikngatlsqeeqrnfwksaynlqlpakqkganl
tfyvlpelkfdsnmnistcfsdrfsffkkqndskldaifgdnnfsafsnyfgeilqlfkeqkt
qkiadylinffdiwrgmedelnrrlvflsnqaqklvqaniatnyadfrmsfggklqswfsgyqn
qnqkiieqlndhgedlkkindavtkqnvkpedeerktdlltdladlqkyqselaggkelefakl
dlyrdllaffrsdfnwffqnylleekekkadkdisvnkkykklfknlrlvpeffglarkkayqk
yidstipiiktgwqvvtdalpilrenmsyeflInpkkkdyfianlekfnrklktktwnrpkfsq
lsekivrhynnnqvptsnqvfyknrfsnsrqeiilidglnqekelkwlvnscleclakpvlsad
aglmidqleltkmvlgwlingnndsiinfdkydlanfikaskfievfktnqfagrqlsrflmsy
ifgelrgavglfsrqsfvnryvvspmaslsnyplvndgakwylalgkssskkpkegmkefteyad
kesdkaksahffpddllyvsssiyqmqflhalkrqkegkkwhkwqqinlklsdhafivedeyqv
kwdlitgkpnlkrvaenrrvfvsvpfilnplseqktqsenianryrylgidvgeyglayavldf
snkkraeiidqgfiydgslrkirdhfdlikdtqtkgtfsvpstalsrvrenaitalrnkihdlv
lrfnakpvyefsisnfetgsgkvtkiynsvkkadiypeidtdkavqkhiwgknpkligqevsay
atsytcskchqsiydqgldkeskikanqiinasptglikiklvskveawgfvkgsrkleitene
rtvslfkgqkigdevaqrlvknfarppineaseaiklamsqkklnsnminfeklaedrgnmamf
vcpfclhvddadiqaaqnialrgflknefekdnngkkesfnyiqavknffqsggmadyne
    (SEQ ID NO: 56)

FIG. 1 (Cont.)

>CasY15
mnekktatqrrnarrrrgerartksqelrgyrlhdariefsgglgsmrtvkvellnpdssredp
qrgqglqgkvakavfddyralygpmniedylsdpdcpsflglwvkavclgvimsrktatdfgel
rggsksgqafdsipehlrrqliklkwldwydkgirkssskasrlksltdvfanpkqpdqgvmaa
weqgeklaessrdiaalgrrefkdklfaippptssvvldddvkatkvsrdwqwavdpqfklpst
dlditraleevdrqwferlgnnrgmvqqffaigdngnhlnnglfghffasirsanladivaemg
tafgfsaeerdivrqrletlheyaqglpekpvlasrwaeyrtdmtaklgswysnrtskgaasit
qvwgtintetgevkddglvrtleniqsdlpdscsikegilqetldfigdrrsstdraftdelel
ylatlrsdlntwcqeqsalweekqrqvatpasdekskkadnpwagkgsktdkwlgalhtriqss
plfwgvdklelwktlanlkqairdeidklneqvevfgrsaydepvgkdadsgegdrrvdqlsyl
sarlgdqaheevrqrldaialalgvkfserddlhrffvssrarrraallampntitvgklrela
dltplwerikkkpeeprlladtvalskvvnsacasranpsdqielttihsrldgysknightef
isratvqstngaqntvaldslvsprlfyynfpnivesaephvshlevatrgnlgsfeefaakeh
rtfdrenpqkdsmridsvnplavassryqiqfftwwaglhrsketalevggsftiaerqvrld
wsqekpqavvseelrvfvsqpftivpddkkrpatsgtryigvdigeyglawscwefapgywngs
vvnpskvtcldygflaepgqrrivervkklresqatktftspdtyiarlrenvvatyqaqleal
mmaynaqlvfeseisafetggnrvkkiydaikrssvfgrsdaeatdnnqhwgkngnrssvkdpd
klrlneagqvaarvpwaepvsawmtsqtcsacgrvyvrayrgknsnepdsgatgevryfdnkqq
kiltktigadtvwvtdqerkefergvynamrpnafmpdgrwtaageileaalksrgtldggrgf
aglhltskaqvheyiegtgkshrdahgnsaificpytdcghiadadlqasynialrgfayaivr
kkhpelfagsgsstdgdegggkkpqqkqafideivraagras (SEQ ID NO: 57)

>CasY16 (truncated)
Manrqispvdstnnfiftlyvsfdtvlyarilafltlscllvgfleyiyplgviylimptnqqy
dgltgyqlhterlrhtgksgirtfklplktndqelfgnffenikhdheggigatnittwteeqk
ssrqiyslldfwldsvragvvfassssaelnellsvcgdedavdeqvktamrainptffkhlkfn
dfkeeialkegmrssstknsvtrrlykcldcteedapeeiqqavadliktffttdgkiisrndq
ddywqvhfgldkslykldsdikltfsflpdipftpeadahmcldkyrcwidenaekfqlesked
ktnflqihwgieqnynafsnyfnqiidllreeegrqklldallntsdlwegaetelqkrfdflv
dkakqlpkakcvdswsdyrttfggrlsswlsntlnqeefikdtvsdqkeelkqiiknseknlyk
kafsaaddnravelsheaviaqktleklqksssfepqllgvyrdnlgrlrsllnkahqllpdei
enksahevysalherirlmpkfiggakaarfekyvkslqilkqgasflenfeekvkeamkssvs
veveeisegyflrqlntlkrfydnandsrfkgklssifdkdlgvnieavsnretfyispyskhd
nravisvevanyqqllkswvnelkpywgniiatenwgeiidamqleririqwiyklypkltfai
sddldelfakaatyrdlhgh (SEQ ID NO: 58)

FIG. 1 (Cont.)

Cas12c (C2c3)

>Cas12c(C2c3) 1

MTKHSIPLHAFRNSGADARKWKGRIALLAKRGKETMRTLQFPLEMSEPEAAAINTTPFAVAYNAIEGTGK
GTLFDYWAKLHLAGFRFFPSGGAATIFRQQAVFEDASWNAAFCQQSGKDWPWLVPSKLYERFTKAPREVA
KKDGSKKSIEFTQENVANESHVSLVGASITDKTPEDQKEFFLKMAGALAEKFDSWKSANEDRIVAMKVID
EFLKSEGLHLPSLENIAVKCSVETKPDNATVAWHDAPMSGVQNLAIGVFATCASRIDNIYDLNGGKLSKL
IQESATTPNVTALSWLFGKGLEYFRTTDIDTIMQDFNIPASAKESIKPLVESAQAIPTMTVLGKKNYAPF
RPNFGGKIDSWIANYASRLMLLNDILEQIEPGFELPQALLDNETLMSGIDMTGDELKELIEAVYAWVDAA
KQGLATLLGRGGNVDDAVQTFEQFSAMMDTLNGTLNTISARYVRAVEMAGKDEARLEKLIECKFDIPKWC
KSVPKLVGISGGLPKVEEEIKVMNAAFMDVRARMFVRFEEIAAYVASKGAGMDVYDALEKRELEQLKKLK
SAVPERAHIQAYRAVLHRIGRAVQNCSEKTKQLFSSKVIEMGVFKNPSHLNNFIFNQKGAIYRSPFDRSR
HAPYQLHADKLLKNDWMELLAEISTTLMASESTEQMEDALRLERTRIQLQLSGLPDWEYPASLAKPDIEV
EIQTALKMQLAKDTVTSDVLQRTFNLYSSVLSGLTFKLLRRSFSLKMRFSVADTTQLIYVPKDCDWAIPK
QYLQAEGEIGIAARVVTESSPAKMVTEVEMKEPKALGHFMQQAPHDWYFDASLGGTQVAGRIVEKGKEVG
KERKLVGYRMRGNSAYKTVLDKSLVGNTELSQCSMIIEIPYTQTVDADFRAQVQAGLPKVSINLPVKETI
TASNKDEQMLFDRFVAIDLGERGLGYAVFDAKTLELQESGHRPIKAITNLLNRTRHYEQRPNQRQKFQAK
FNVNLSELRENTVGDVCHQINRICAYYNAFPVLEYMVPDRLDKQLKSVYESVTNRYIWSSTDAHKSARVQ
FWLGGETWEHPYLKSAKDKKPLVLSPGRGASGKGTSQTCSCCGRNPFDLIKDMKPRAKIAVVDGKAKLEN
SELKLFERNRESKDDMLARRHRNERAGMEQPLTPGNYTVDEIKALLRANLRRAPKNRRTKDTTVSEYHCV
FSDCGKTMHADENAAVNIGGKFIADIEK    (SEQ ID NO: 11)

> Cas12c(C2c3) 2

MKKFELKQNFRNNYSGKTLRNFRQTLAQIANKKSSDSILTIKFKLDCSKTGKLPKYENLISLYDTIEDIK
KGTLSYYLFTLIVSGFKFFGSASQAKAFSTKDIFKDNDFYNQFKIQSHLDLPDFVPSKIYQRLKKNVRST
NGKDNAFKASVIVAEYRKEIGKLKNKDESSEHQCEELFKKIGTALETRFSSWQDLINNCSTGCEIIDEIL
NDSFGTLPSIKKMVLASTTQSSDGEQDGIAIAYDPDSTFIKSDELLNPYFAVATILKSMPPEIQQDKKSA
YVKANLTTPTHNALSWIFGKGLTLFQTESTEKLCAMFNVSDKRVIEQVQDAAKAVKLPAELDLNHCTLKF
QDFRSSLGGHLDSWTTNYLKRLDELNDLLLNLPKNLSLPDIFMIDGKDFIEYSGCNRDEIQQMIDFVVNE
QNRIKLQESLNALLGKGNNQICSDDISTVKDFSEIVNSLHSFVQQIDNSLEQSSNEANSIFSELKKKIEK
NEKWDIWKNNLKKIPKLNKLSGGVPDAWKEIREIEQKFHEISENQKKHFTEVMEWIDAGNGTIDIFESRF
KYDELLKKSKKNNLQSADELAFRSVLNKLGRFARQGNDLVCEKIKNWFKEQNIFDSSKDFNRYFINQKGF
IFKHPSSKKDNSPYNLSANLLEKRYEVTNTVGALLEQCESDPAIVNDPFSMRSLVEFRALWFSINISGIS
KEQHIPTKIAQPKLDDSTYQESVSPTLKYRLEKEQITSSELNSIFTVYKSLLSGLSIRLSRNSFYLRTKF
SWIGNNSLIYCPKETTWKIPAAYFKSDLWNEYKDKQILIVNEEYDVDVVKTFESVYKIVKSKDNNEKNRI
LPLLKQLPHDWMFKLPFGASNAEKCKVLKLEKNNKKFKPLSVSKDSLARLSGPSTYFNQIDEIMMNDESE
LSEMTLLADEPVRQQMSNGKIEIIPDDYVMSLAIPITRSLKKGNTESFPFKNIVSIDQGEAGFAYAVFKL
SDCGNERAEPIATGLIPIPSIRRLIHSVKKYRGKKQRIQNFNQKFDSTMFTLRENVTGDICGLIVALMKK
YNAFPILEKQVGNLESGSKQLMLVYKAVNSKFLAAKVDMQNDQRRSWWYQGNSWNTPILRISNPNQSNNK
NIVKNINGKKYEELKIYPGYSVSAYMTSCICHVCGRNALELLKNDDSTGKVKKYQINQDGEVTIGGEVIK
LYRKPDRLTPVKNLAKKGNRERTYASINERAP
    (SEQ ID NO: 12)

FIG. 1 (Cont.)

>C2c3_3
MTKLRHRQKKLTHDWAGSKKREVLGSNGKLQNPLLMPVKKGQVTEFRKAFSAYARATKGE
MTDGRKNMFTHSFEPFKTKPSLHQCELADKAYQSLHSYLPGSLAHFLLSAHALGFRIFSK
SGEATAFQASSKIEAYESKLASELACVDLSIQNLTISTLFNALTTSVRGKGEETSADPLI
ARFYTLLTGKPLSRDTQGPERDLAEVISRKIASSFGTWKEMTANPLQSLQFFEEELHALD
ANVSLSPAFDVLIKMNDLQGDLKNRTIVFDPDAPVFEYNAEDPADIIIKLTARYAKEAVI
KNQNVGNYVKNAITTTNANGLGWLLNKGLSLLPVSTDDELLEFIGVERSHPSCHALIELI
AQLEAPELFEKNVFSDTRSEVQGMIDSAVSNHIARLSSSRNSLSMDSEELERLIKSFQIH
TPHCSLFIGAQSLSQQLESLPEALQSGVNSADILLGSTQYMLTNSLVEESIATYQRTLNR
INYLSGVAGQINGAIKRKAIDGEKIHLPAAWSELISLPFIGQPVIDVESDLAHLKNQYQT
LSNEFDTLISALQKNFDLNFNKALLNRTQHFEAMCRSTKKNALSKPEIVSYRDLLARLTS
CLYRGSLVLRRAGIEVLKKHKIFESNSELREHVHERKHFVFVSPLDRKAKKLLRLTDSRP
DLLHVIDEILQHDNLENKDRESLWLVRSGYLLAGLPDQLSSSFINLPIITQKGDRRLIDL
IQYDQINRDAFVMLVTSAFKSNLSGLQYRANKQSFVVTRTLSPYLGSKLVYVPKDKDWLV
PSQMFEGRFADILQSDYMVWKDAGRLCVIDTAKHLSNIKKSVFSSEEVLAFLRELPHRTF
IQTEVRGLGVNVDGIAFNNGDIPSLKTFSNCVQVKVSRTNTSLVQTLNRWFEGGKVSPPS
IQFERAYYKKDDQIHEDAAKRKIRFQMPATELVHASDDAGWTPSYLLGIDPGEYGMGLSL
VSINNGEVLDSGFIHINSLINFASKKSNHQTKVVPRQQYKSPYANYLEQSKDSAAGDIAH
ILDRLIYKLNALPVFEALSGNSQSAADQVWTKVLSFYTWGDNDAQNSIRKQHWFGASHWD
IKGMLRQPPTEKKPKPYIAFPGSQVSSYGNSQRCSCCGRNPIEQLREMAKDTSIKELKIR
NSEIQLFDGTIKLFNPDPSTVIERRRHNLGPSRIPVADRTFKNISPSSLEFKELITIVSR
SIRHSPEFIAKKRGIGSEYFCAYSDCNSSLNSEANAAANVAQKFQKQLFFEL
   (SEQ ID NO: 13)

>C2c3_4
MATKKLMKSGAQLRAFRRYLASRADRPAEKYTRTLKFPLEDTGFFNNPEDFQAAVKLYNI
TEGVEVYTLYGLLMRLHLGGFRLFSSATKAYTFRNSEVFDNAQFRMALQDTFGVESKKLD
VESIYGDLKRARRNTGGRVKHLSGRELAEDYYQRATGKKVDTGSSDFNAGLFDFLKTFGR
AIEEKFSSWAEVNEDINSGNNVAITCLDKTLAEYSVSLPLINGQLALLSEAKQSNSTIAF
DRNKKIIANYPIEIAIHIVVAQYLQEIQKEAPTKSAAIKHLQSNITTETHSGLSWLLGAG
LKYLAVTDDKIILDELEITNAKAVGELTDIARTISPVAFLGDNNYSSYRRTFGGKLDSWT
ANYATRLYELDAALIGMDAAFCLPASLSDPRAASLLDGMAVNITELNALVKGLYSRRDDA
RVSLNQLLGRDLELPELGDVETVEAFSDELNAVSGLLNMLGNRLKQEQEYAEASRNIPQE
DFLRSCSFTKPVWLKKLPKLNQISGGVPDYKQELKQSVEDFNVTRQLMQAHFARIEKYVK
DHHIALDVLGNLATREQLHINRFREQRPSVTTRESATTRAYRNLFHRIAKVGMSCSPEVK
DKVKALLQSWDVFSSKKDLNRLFNNRQGAIYQSLFSTRQHDPYALNEEALNTKPYMDLFR
DFITQLQTQIYESGFSKYNDLLKLERTYYGLMLGGLPDNLPKALGELALPEHLMNLSPIL
KGALSQKTLSTETIIKAFNHYHSVLNGLAAKLLREEFLVRAKFTRVGDTALVYQAKDKIW
TVPERYITTNKEIGSVFKQPPLANLLDDNKLEVRAGIEALSSAYRSDWGQRAKDGALTPY
LRQSPHDWKYALDYGASKGTREPGFKCDKKAPRKYSDSHTGLVRLIGPSSFKEWLDKAML
TKEAEIGDQTLIIDQRIKQSIQQTETGIEVVTEPSGGIINLAVPLTELLPKGEPEFILDH
FVAIDLGEVGIGYAVFKVDDFKLVAHGSIPIRSIRNLMSSVERHRRLRQPQQKFQASYNP
LLSQLRQNAIGDTLGVVDGLMEQFNAFPVFESSVGNFERGANQLKIIYESVLKNYTFSNI
DAHKATRKHHWCGGEKWTHPELRVWELNDKGERTGSDRQLNLFPGASVHPAGTSQTCSKC
QRNPIKEVYAVLDADARTVFKVDAKGEYKLSSGNSICLYTTPRLSSKELKNTRRCKLNRQ
PTAKLMDEFKGDEMLKAIRRCLRFQKSSRSKDTSQSRYRCLYSDCGHSMHADENAAINI
GLKWVREKVVP    (SEQ ID NO: 14)

FIG. 1 (Cont.)

>C2c3_5 minkwmmqsgaqlrafrcavtqtsnrppkkitrtlkfpleetdffdnpdnfeaatalyqi
tegigtesiygllmrlhlagfrlfassneartfcnrssfdnsafrqalldtfgvqskhld
ieaiyldlrkqrrvingkvkalsaqalaesyyllaigsvansekpnfnkaffnflydfgq
alegsfaswaevnaditcsdstalthldhtikqhglnlpsvkqkitqlrdlkpencpvvf
dgnkiiveqypddiaihivtaqylqeiqstkpsckqavdhvqgrittqthnglswllgvg
ldylattnikqiaqdwntsksavlqqlidiakallpvpfldnrnyakyrrsvggkldswl
anyinrlfdlhsalestqcdfalpkalstedasafftqmtvnytefsalietlnktmqqa
enalqrlfgcstslpdaqdvqaieqlskqlntvsgllnmldnrleqerkiakdnnqqqkl
elldqcafdspdwlkelpklnaisggvpdyqqqlqqtakdfnltytvmhqhyariknycs
kqsialdvlgnitakeqqyierfktlrinaktaespliranhrnilhriakvasncspvvr
eqvrqlfldwgvfkskkhlnsffinrkgaiyqslfsrsnhqpyaldetalantnylqafs
qylnkleqqcndnfalysdslalrkvyytimlsglpddlpaeigqialpehllnlspilk
aaleqqtlraetlikvfnyyhsllngftaflvrdefivrtkftrvadieliyqaknkiwq
vpehyikspkaigkvlaqlplnellndnqlnvpegiealskhhkkhwatdtrngeldflr
qsphdwkyqlgygqtqqkqsgfkcfgkknkrnqnytghtglvrligpsttkewldkamlt
nqaeigditllidqhikqtidannagislktqpaggqitlavpvtewlaedkenifdyfv
aidlgevgigyavfavdgfnliaqgniairsirnligavnrhrgnrqprqkfqasyqpql
arlrnnaigdtlgvidglmqgfsafpifessvgsfergarqlkmiyesvlknytfsnvga
hkaarkhhwcggdrwlhpslqvwkinekgentgkkkplnlfpgasvhpagtsqtcsqcgr
nplqglrsftdknrrppfipnsnseyqlpsgesiylytyptlttqqqrerrrqklnpqpt
ermskelygdeiikaikrclrfkpdssrskdtsqsqyrclysdcghamhadenaainign
kwmntklvrns (SEQ ID NO: 15)

>C2c3_6 mqtkkthlhlisakasrkyrrtiaclsdtakkdlerrkqsgaadpaqelsclktikfkle
vpegsklpsfdrisqiynaletiekgslsyllfalilsgfrifpnssaaktfassscykn
dqfasqikeifgemvknfipselesilkkgrrknnkdwteenikrvlnsefgrknsegss
alfdsflskfsqelfrkfdswnevnkkyleaaelldsmlasygpfdsvckmigdsdsrns
lpdkstiaftnnaeitvdiessvmpymaiaallreyrqskskaapvayvqshltttngng
lswffkfgldlirkapvsskqstsdgskslqelfsvpddkldglkfikeacealpeasll
cgekgellgyqdfrtsfaghidswvanyvnrlfelielvnqlpesiklpsiltqknhnlv
aslglqeaevshslelfeglvknvrqtlkklagidissspneqdikefyafsdvlnrlgs
irnqienavqtakkdkidlesaiewkewkklkklpklnglgggvpkqqelldkalesvkq
irhyqridferviqwavnehcletvpkflvdaekkkinkesstdfaakenavrfllegig
aaargktdsvskaaynwfvvnnflakkdlnryfincqgciykppyskrrslafalrsdnk
dtievvwekfetfykeiskeiekfnifsqefqtflhlenlrmklllrriqkpipaeiaff
slpqeyydslppnvaflalnqeitpseyitqfnlyssflngnlillrrsrsylrakfswv
gnskliyaakearlwkipnaywksdewkmildsnvlvfdkagnvlpaptlkkvceregdl
rlfypllrqlphdwcyrnpfvksvgreknvievnkegepkvasalpgslfrligpapfks
lldcffnpldkdlrecmlivdqeisqkveaqkveaslesctysiavpiryhleepkvsn
qfenvlaidqgeaglayavfslksigeaetkpiavgtiripsirrlihsvstyrkkkqrl
qnfkqnydstafimrenvtgdvcakivglmkefnafpvleydvknlesgsrqlsavykav
nshflyfkepgrdalrkqlwyggdswtidgieivtrerkedgkegvekivplkvfpgrsv
sarftsktcsccgrnvfdwlftekkaktnkkfnvnskgelttadgviqlfeadrskgpkf
yarrkertpltkpiakgsysleeierrvrtnlrrapkskqsrdtsqsqyfcvykdcalhf
sgmqadenaainigrrfltalrknrrsdfpsnvkisdrlldn (SEQ ID NO: 16)

FIG. 1 (Cont.)

> Cas12c(C2c3)_7

MTKHSIPLHAFRNSGADARKWKGRIALLAKRGKETMRTLQFPLEMSEPEAAAINTTPFAVAYNAIEGTGK
GTLFDYWAKLHLAGFRFFPSGGAATIFRQQAVFEDASWNAAFCQQSGKDWPWLVPSKLYERFTKAPREVA
KKDGSKKSIEFTQENVANESHVSLVGASITDKTPEDQKEFFLKMAGALAEKFDSWKSANEDRIVAMKVID
EFLKSEGLHLPSLENIAVKCSVETKPDNATVAWHDAPMSGVQNLAIGVFATCASRIDNIYDLNGGKLSKL
IQESATTPNVTALSWLFGKGLEYFRTTDIDTIMQDFNIPASAKESIKPLVESAQAIPTMTVLGKKNYAPF
RPNFGGKIDSWIANYASRLMLLNDILEQIEPGFELPQALLDNETLMSGIDMTGDELKELIEAVYAWVDAA
KQGLATLLGRGGNVDDAVQTFEQFSAMMDTLNGTLNTISARYVRAVEMAGKDEARLEKLIECKFDIPKWC
KSVPKLVGISGGLPKVEEEIKVMNAAFKDVRARMFVRFEEIAAYVASKGAGMDVYDALEKRELEQIKKLK
SAVPERAHIQAYRAVLHRIGRAVQNCSEKTKQLFSSKVIEMGVFKNPSHLNNFIFNQKGAIYRSPFDRSR
HAPYQLHADKLLKNDWLELLAEISATLMASESTEQMEDALRLERTRLQLQLSGLPDWEYPASLAKPDIEV
EIQTALKMQLAKDTVTSDVLQRAFNLYSSVLSGLTFKLLRRSFSLKMRFSVADTTQLIYVPKVCDWAIPK
QYLQAEGEIGIAARVVTESSPAKMVTEVEMKEPKALGHFMQQAPHDWYFDASLGGTQVAGRIVEKGKEVG
KERKLVGYRMRGNSAYKTVLDKSLVGNTELSQCSMIIEIPYTQTVDADFRAQVQAGLPKVSINLPVKETI
TASNKDEQMLFDRFVAIDLGERGLGYAVFDAKTLELQESGHRPIKAITNLLNRTHHYEQRPNQRQKFQAK
FNVNLSELRENTVGDVCHQINRICAYYNAFPVLEYMVPDRLDKQLKSVYESVTNRYIWSSTDAHKSARVQ
FWLGGETWEHPYLKSAKDKKPLVLSPGRGASGKGTSQTCSCCGRNPFDLIKDMKPRAKIAVVDGKAKLEN
SELKLFERNLESKDDMLARRHRNERAGMEQPLTPGNYTVDEIKALLRANLRRAPKNRRTKDTTVSEYHCV
FSDCGKTMHADENAAVNIGGKFIADIEK (SEQ ID NO: 17)

> Cas12c(C2c3)_8

MTKLRHRQKKLTHDWAGSKKREVLGSNGKLQNPLLMPVKKGQVTEFRKAFSAYARATKGEMTDGRKNMFT
HSFEPFKTKPSLHQCELADKAYQSLHSYLPGSLAHFLLSAHALGFRIFSKSGEATAFQASSKIEAYESKL
ASELACVDLSIQNLTISTLFNALTTSVRGKGEETSADPLIARFYTLLTGKPLSRDTQGPERDLAEVISRK
IASSFGTWKEMTANPLQSLQFFEEELHALDANVSLSPAFDVLIKMNDLQGDLKNRTIVFDPDAPVFEYNA
EDPADIIIKLTARYAKEAVIKNQNVGNYVKNAITTTNANGLGWLLNKGLSLLPVSTDDELLEFIGVERSH
PSCHALIELIAQLEAPELFEKNVFSDTRSEVQGMIDSAVSNHIARLSSSRNSLSMDSEELERLIKSFQIH
TPHCSLFIGAQSLSQQLESLPEALQSGVNSADILLGSTQYMLTNSLVEESIATYQRTLNRINYLSGVAGQ
INGAIKRKAIDGEKIHLPAAWSELISLPFIGQPVIDVESDLAHLKNQYQTLSNEFDTLISALQKNFDLNF
NKALLNRTQHFEAMCRSTKKNALSKPEIVSYRDLLARLTSCLYRGSLVLRRAGIEVLKKHKIFESNSELR
EHVHERKHFVFVSPLDRKAKKLLRLTDSRPDLLHVIDEILQHDNLENKDRESLWLVRSGYLLAGLPDQLS
SSFINLPIITQKGDRRLIDLIQYDQINRDAFVMLVTSAFKSNLSGLQYRANKQSFVVTRTLSPYLGSKLV
YVPKDKDWLVPSQMFEGRFADILQSDYMVWKDAGRLCVIDTAKHLSNIKKSVFSSEEVLAFLRELPHRTF
IQTEVRGLGVNVDGIAFNNGDIPSLKTFSNCVQVKVSRTNTSLVQTLNRWFEGGKVSPPSIQFERAYYKK
DDQIHEDAAKRKIRFQMPATELVHASDDAGWTPSYLLGIDPGEYGMGLSLVSINNGEVLDSGFIHINSLI
NFASKKSNHQTKVVPRQQYKSPYANYLEQSKDSAAGDIAHILDRLIYKLNALPVFEALSGNSQSAADQVW
TKVLSFYTWGDNDAQNSIRKQHWFGASHWDIKGMLRQPPTEKKPKPYIAFPGSQVSSYGNSQRCSCCGRN
PIEQLREMAKDTSIKELKIRNSEIQLFDGTIKLFNPDPSTVIERRRHNLGPSRIPVADRTFKNISPSSLE
FKELITIVSRSIRHSPEFIAKKRGIGSEYFCAYSDCNSSLNSEANAAANVAQKFQKQLFFEL
(SEQ ID NO: 18)

FIG. 1 (Cont.)

CasZ

CasZa

>CasZa.1|rifcsphigho2_02_scaffold_2167_39 \N id=61050970
partial=0 scaf=rifcsphigho2_02_scaffold_2167
bin=RIFCSPHIGHO2_02_FULL_Archaea_Woesearchaeota_57_22
sample=Archaea-Rifle02 proj=Rifle Groundwater Metagenome
mEVQKTVMKTLSLRILRPLYSQEIEKEIKEEKERRKQAGGTGELDGGFYKKLEKKHSEMFSFDR
LNLLLNQLQREIAKVYNHAISELYIATIAQGNKSNKHYISSIVYNRAYGYFYNAYIALGICSKV
EANFRSNELLTQQSALPTAKSDNFPIVLHQKGAEGEDGGFRISTEGSDLIFEIPIPFYEYNGE
NRKEPYKWVKKGGQKPVLKLILSTFRRQRNKGWAKDEGTDAEIRKVTEGKYQVSQIEINRGKKL
GEHQKWFANFSIEQPIYERKPNRSIVGGLDVGIRSPLVCAINNSFSRYSVDSNDVFKFSKQVFA
FRRRLLSKNSLKRKGHGAAHKLEPITEMTEKNDKFRKKIIERWAKEVTNFFVKNQVGIVQIEDL
STMKDREDHFFNQYLRGFWPYYQMQTLIENKLKEYGIEVKRVQAKYTSQLCSNPNCRYWNNYFN
FEYRKVNKFPKFKCEKCNLEISADYNAARNLSTPDIEKFVAKATKGINLPEK
      (SEQ ID NO: 19)

>CasZa.2|gwa2_scaffold_18027_12 Putative transposase DNA-binding
domain family id=262569 partial=0 scaf=gwa2_scaffold_18027
bin=GWA2_Unbinned sample=GWA2 proj=Rifle Groundwater Metagenome
mEEAKTVSKTLSLRILRPLYSAEIEKEIKEEKERRKQGGKSGELDSGFYKKLEKKHTQMFGWDK
LNLMLSQLQRQIARVFNQSISELYIETVIQGKKSNKHYTSKIVYNRAYSVFYNAYLALGITSKV
EANFRSTELLMQKSSLPTAKSDNFPILLHQKGVEGEEGGFKISADGNDLIFEIPIPFYEYDSA
NKKEPFKWIKKGGQKPTIKLILSTFRRQRNKGWAKDEGTDAEIRKVIEGKYQVSHIEINRGKKL
GDHQKWFVNFTIEQPIYERKLDKNIIGGIDVGIKSPLVCAVNNSFARYSVDSNDVLKFSKQAFA
FRRRLLSKNSLKRSGHGSKNKLDPITRMTEKNDRFRKKIIERWAKEVTNFFIKNQVGTVQIEDL
STMKDRQDNFFNQYLRGFWPYYQMQNLIENKLKEYGIETKRIKARYTSQLCSNPSCRHWNSYFS
FDHRKTNNFPKFKCEKCALEISADYNAARNISTPDIEKFVAKATKGINLPDKNENVILE
      (SEQ ID NO: 20)

>CasZa.3|gwa1_scaffold_1795_31 Transposase, IS605 OrfB family
id=2784443 partial=0 scaf=gwa1_scaffold_1795
bin=GWA1_Archaeon_57_19 sample=GWA1 proj=Rifle Groundwater
Metagenome
mAKNTITKTLKLRIVRPYNSAEVEKIVADEKNNREKIALEKNKDKVKEACSKHLKVAAYCTTQV
ERNACLFCKARKLDDKFYQKLRGQFPDAVFWQEISEIFRQLQKQAAEIYNQSLIELYYEIFIKG
KGIANASSVEHYLSDVCYTRAAELFKNAAIASGLRSKIKSNFRLKELKNMKSGLPTTKSDNFPI
PLVKQKGGQYTGFEISNHNSDFIIKIPFGRWQVKKEIDKYRPWEKFDFEQVQKSPKPISLLLST
QRRKRNKGWSKDEGTEAEIKKVMNGDYQTSYIEVKRGSKIGEKSAWMLNLSIDVPKIDKGVDPS
IIGGIDVGVKSPLVCAINNAFSRYSISDNDLFHFNKKMFARRRILLKKNRHKRAGHGAKNKLKP
ITILTEKSERFRKKLIERWACEIADFFIKNKVGTVQmENLESMKRKEDSYFNIRLRGFWPYAEM
QNKIEFKLKQYGIEIRKVAPNNTSKTCSKCGHLNNYFNFEYRKKNKFPHFKCEKCNFKENADYN
AALNISNPKLKSTKEEP (SEQ ID NO: 21)

FIG. 1 (Cont.)

>CasZa.4|CG10_big_fil_rev_8_21_14_0.10_scaffold_20906_2 \N
id=132542232 partial=0
scaf=CG10_big_fil_rev_8_21_14_0.10_scaffold_20906
bin=CG10_big_fil_rev_8_21_14_0_10_UNK
sample=CG10_big_fil_rev_8_21_14_0_10 proj=Crystal Geyser
mERQKVPQIRKIVRVVPLRILRPKYSDVIENALKKFKEKGDDTNTNDFWRAIRDRDTEFFRKEL
NFSEDEINQLERDTLFRVGLDNRVLFSYFDFLQEKLMKDYNKIISKLFINRQSKSSFENDLTDE
EVEELIEKDVTPFYGAYIGKGIKSVIKSNLGGKFIKSVKIDRETKKVTKLTAINIGLMGLPVAK
SDTFPIKIIKTNPDYITFQKSTKENLQKIEDYETGIEYGDLLVQITIPWFKNENKDFSLIKTKE
AIEYYKLNGVGKKDLLNINLVLTTYHIRKKKSWQIDGSSQSLVREMANGELEEKWKSFFDTFIK
KYGDEGKSALVKRRVNKKSRAKGEKGRELNLDERIKRLYDSIKAKSFPSEINLIPENYKWKLHF
SIEIPPMVNDIDSNLYGGIDFGEQNIATLCVKNIEKDDYDFLTIYGNDLLKHAQASYARRRIMR
VQDEYKARGHGKSRKTKAQEDYSERMQKLRQKITERLVKQISDFFLWRNKFHMAVCSLRYEDLN
TLYKGESVKAKRMRQFINKQQLFNGIERKLKDYNSEIYVNSRYPHYTSRLCSKCGKLNLYFDFL
KFRTKNIIIRKNPDGSEIKYMPFFICEFCGWKQAGDKNASANIADKDYQDKLNKEKEFCNIRKP
KSKKEDIGEENEEERDYSRRFNRNSFIYNSLKKDNKLNQEKLFDEWKNQLKRKIDGRNKFEPKE
YKDRFSYLFAYYQEIIKNESES (SEQ ID NO: 22)

>CasZa.5|rifcsplowo2_01_scaffold_34461_9 \N id=58382281
partial=0 scaf=rifcsplowo2_01_scaffold_34461
bin=RifCSPlowO2_01_full_UNK sample=RIFCSPLOWO2_01_FULL
proj=RifleCSP2_LowO2
mVPTELITKTLQLRVIRPLYFEEIEKELAELKEQKEKEFEETNSLLLESKKIDAKSLKKLKRKA
RSSAAVEFWKIAKEKYPDILTKPEMEFIFSEMQKMMARFYNKSMTNIFIEMNNDEKVNPLSLIS
KASTEANQVIKCSSISSGLNRKIAGSINKTKFKQVRDGLISLPTARTETFPISFYKSTANKDEI
PISKINLPSEEEADLTITLPFPFFEIKKEKKGQKAYSYFNIIEKSGRSNNKIDLLLSTHRRQRR
KGWKEEGGTSAEIRRLMEGEFDKEWEIYLGEAEKSEKAKNDLIKNMTRGKLSKDIKEQLEDIQV
KYFSDNNVESWNDLSKEQKQELSKLRKKKVEELKDWKHVKEILKTRAKIGWVELKRGKRQRDRN
KWFVNITITRPPFINKELDDTKFGGIDLGVKVPFVCAVHGSPARLIIKENEILQFNKMVSARNR
QITKDSEQRKGRGKKNKFIKKEIFNERNELFRKKIIERWANQIVKFFEDQKCATVQIENLESFD
RTSYK (SEQ ID NO: 23)

>CasZa.6|O37|3300012359.a:Ga0137385_10000156_01776
Zr6.cluA_1a.mostcl0like protein
MKSDTKDKKIIIHQTKTLSLRIVKPQSIPMEEFTDLVRYHQMIIFPVYNNGAIDLYKKLFKAKI
QKGNEARAIKYFMNKIVYAPIANTVKNSYIALGYSTKMQSSFSGKRLWDLRFGEATPPTIKADF
PLPFYNQSGFKVSSENGEFIIGIPFGQYTKKTVSDIEKKTSFAWDKFTLEDTTKKTLIELLLST
KTRKMNEGWKNNEGTEAEIKRVMDGTYQVTSLEILQRDDSWFVNFNIAYDSLKKQPDRDKIAGI
HMGITRPLTAVIYNNKYRALSIYPNTVMHLTQKQLARIKEQRTNSKYATGGHGRNAKVTGTDTL
SEAYRQRRKKIIEDWIASIVKFAINNEIGTIYLEDISNTNSFFAAREQKLIYLEDISNTNSFLS
TYKYPISAISDTLQHKLEEKAIQVIRKKAYYVNQICSLCGHYNKGFTYQFRRKNKFPKMKCQGC
LEATSTEFNAAANVANPDYEKLLIKHGLLQLKK  (SEQ ID NO: 24)

FIG. 1 (Cont.)

>CasZa.7|127|3300009029.a:Ga0066793_10010091_01298
Zr6.cluA_1.c10.inclusive
MSTITRQVRLSPTPEQSRLLMAHCQQYISTVNVLVAAFDSEVLTGKVSTKDFRAALPSAVKNQA
LRDAQSVFKRSVELGCLPVLKKPHCQWNNQNWRVEGDQLILPICKDGKTQQERFRCAAVALEGK
AGILRIKKKRGKWIADLTVTQEDAPESSGSAIMGVDLGIKVPAVAHIGGKGTRFFGNGRSQRSM
RRRFYARRKTLQKAKKLRAVRKSKGKEARWMKTINHQLSRQIVNHAHALGVGTIKIEALQGIRK
GTTRKSRGAAARKNNRMTNTWSFSQLTLFITYKAQRQGITVEQVDPAYTSQDCPACRARNGAQD
RTYVCSECGWRGHRDTVGAINISRRAGLSGHRRGATGA (SEQ ID NO: 25)

*CasZb*

>CasZb.1|bjp_ig2599_sub10_scaffold_488_2 transposase id=60827220
partial=0 scaf=bjp_ig2599_sub10_scaffold_488
bin=BJP_IG2599_SUB10_Micrarchaeota_NOVEL_41_24
sample=BJP_IG2599_SUB10 proj=Borehole JP
mIAQKTIKIKLNPTKEQIIKLNSIIEEYIKVSNFTAKKIAEIQESFTDSGLTQGTCSECGKEKT
YRKYHLLKKDNKLFCITCYKRKYSQFTLQKVEFQNKTGLRNVAKLPKTYYTNAIRFASDTFSGF
DEIIKKKQNRLNSIQNRLNFWKELLYNPSNRNEIKIKVVKYAPKTDTREHPHYYSEAEIKGRIK
RLEKQLKKFKMPKYPEFTSETISLQRELYSWKNPDELKISSITDKNESmNYYGKEYLKRYIDLI
NSQTPQILLEKENNSFYLCFPITKNIEMPKIDDTFEPVGIDWGITRNIAVVSILDSKTKKPKFV
KFYSAGYILGKRKHYKSLRKHFGQKKRQDKINKLGTKEDRFIDSNIHKLAFLIVKEIRNHSNKP
IILMENITDNREEAEKSMRQNILLHSVKSRLQNYIAYKALWNNIPTNLVKPEHTSQICNRCGHQ
DRENRPKGSKLFKCVKCNYMSNADFNASINIARKFYIGEYEPFYKDNEKMKSGVNSISM (SEQ
ID NO: 26)

>CasZb.2|rifcsplowo2_01_scaffold_239_52 IS605 OrfB family
transposase id=57672634 partial=0
scaf=rifcsplowo2_01_scaffold_239 bin=RifCSPlowO2_01_full_UNK
sample=RIFCSPLOWO2_01_FULL proj=RifleCSP2_LowO2
LKLSEQENITTGVKFKLKLDKETSEGLNDYFDEYGKAINFAIKVIQKELAEDRFAGKVRLDENK
KPLLNEDGKKIWDFPNEFCSCGKQVNRYVNGKSLCQECYKNKFTEYGIRKRMYSAKGRKAEQDI
NIKNSTNKISKTHFNYAIREAFILDKSIKKQRKERFRRLREMKKKLQEFIEIRDGNKILCPKIE
KQRVERYIHPSWINKEKKLEDFRGYSMSNVLGKIKILDRNIKREEKSLKEKGQINFKARRLMLD
KSVKFLNDNKISFTISKNLPKEYELDLPEKEKRLNWLKEKIKIIKNQKPKYAYLLRKDDNFYLQ
YTLETEFNLKEDYSGIVGIDRGVSHIAVYTFVHNNGKNERPLFLNSSEILRLKNLQKERDRFLR
RKHNKKRKKSNMRNIEKKIQLILHNYSKQIVDFAKNKNAFIVFEKLEKPKKNRSKMSKKSQYKL
SQFTFKKLSDLVDYKAKREGIKVLYISPEYTSKECSHCGEKVNTQRPFNGNSSLFKCNKCGVEL
NADYNASINIAKKGLNILNSTN
(SEQ ID NO: 27)

FIG. 1 (Cont.)

>CasZb.3|rifcsplowo2_01_scaffold_282_93 IS605 OrfB family
transposase id=57678680 partial=0
scaf=rifcsplowo2_01_scaffold_282 bin=RifCSPlowO2_01_full_UNK
sample=RIFCSPLOWO2_01_FULL proj=RifleCSP2_LowO2
mEESIITGVKFKLRIDKETTKKLNEYFDEYGKAINFAVKIIQKELADDRFAGKAKLDQNKNPIL
DENGKKIYEFPDEFCSCGKQVNKYVNNKPFCQECYKIRFTENGIRKRMYSAKGRKAEHKINILN
STNKISKTHFNYAIREAFILDKSIKKQRKKRNERLRESKKRLQQFIDMRDGKREICPTIKGQKV
DRFIHPSWITKDKKLEDFRGYTLSIINSKIKILDRNIKREEKSLKEKGQIIFKAKRLMLDKSIR
FVGDRKVLFTISKTLPKEYELDLPSKEKRLNWLKEKIEIIKNQKPKYAYLLRKNIESEKKPNYE
YYLQYTLEIKPELKDFYDGAIGIDRGINHIAVCTFISNDGKVTPPKFFSSGEILRLKNLQKERD
RFLLRKHNKNRKKGNMRVIENKINLILHRYSKQIVDmAKKLNASIVFEELGRIGKSRTKMKKSQ
RYKLSLFIFKKLSDLVDYKSRREGIRVTYVPPEYTSKECSHCGEKVNTQRPFNGNYSLFKCNKC
GIQLNSDYNASINIAKKGLKIPNST
    (SEQ ID NO: 35)

>CasZb.4|rifcsphigho2_01_scaffold_36781_5 transposase, IS605
OrfB family id=55842010 partial=0
scaf=rifcsphigho2_01_scaffold_36781 bin=RifCSPhighO2_01_full_UNK
sample=RIFCSPHIGHO2_01_FULL proj=RifleCSP2_HighO2
LWTIVIGDFIEMPKQDLVTTGIKFKLDVDKETRKKLDDYFDEYGKAINFAVKIIQKNLKEDRFA
GKIALGEDKKPLLDKDGKKIYNYPNESCSCGNQVRRYVNAKPFCVDCYKLKFTENGIRKRMYSA
RGRKADSDINIKNSTNKISKTHFNYAIREGFILDKSLKKQRSKRIKKLLELKRKLQEFIDIRQG
QMVLCPKIKNQRVDKFIHPSWLKRDKKLEEFRGYSLSVVEGKIKIFNRNILREEDSLRQRGHVN
FKANRIMLDKSVRFLDGGKVNFNLNKGLPKEYLLDLPKKENKLSWLNEKISLIKLQKPKYAYLL
RREGSFFIQYTIENVPKTFSDYLGAIGIDRGISHIAVCTFVSKNGVNKAPVFFSSGEILKLKSL
QKQRDLFLRGKHNKIRKKSNMRNIDNKINLILHKYSRNIVNLAKSEKAFIVFEKLEKIKKSRFK
MSKSLQYKLSQFTFKKLSDLVEYKAKIEGIKVDYVPPEYTSKECSHCGEKVDTQRPFNGNSSLF
KCNKCRVQLNADYNASINIAKKSLNISNN (SEQ ID NO: 36)

>CasZb.5|cg1_0.2_scaffold_785_c_37 transposase, IS605 OrfB
family id=91826491 partial=0 scaf=cg1_0.2_scaffold_785_c
bin=CG1_02_FULL_Micrarchaeota_47_40_curated sample=CG1_02_FULL
proj=Crystal Geyser
mSKTTISVKLKIIDLSSEKKEFLDNYFNEYAKATTFCQLRIRRLLRNTHWLGKKEKSSKKWIFE
SGICDLCGENKELVNEDRNSGEPAKICKRCYNGRYGNQMIRKLFVSTKKREVQENMDIRRVAKL
NNTHYHRIPEEAFDMIKAADTAEKRRKKNVEYDKKRQMEFIEMFNDEKKRAARPKKPNERETRY
VHISKLESPSKGYTLNGIKRKIDGMGKKIERAEKGLSRKKIFGYQGNRIKLDSNWVRFDLAESE
ITIPSLFKEMKLRITGPTNVHSKSGQIYFAEWFERINKQPNNYCYLIRKTSSNGKYEYYLQYTY
EAEVEANKEYAGCLGVDIGCSKLAAAVYYDSKNKKAQKPIEIFTNPIKKIKMRREKLIKLLSRV
KVRHRRRKLMQLSKTEPIIDYTCHKTARKIVEMANTAKAFISMENLETGIKQKQQARETKKQKF
YRNMFLFRKLSKLIEYKALLKGIKIVYVKPDYTSQTCSSCGADKEKTERPSQAIFRCLNPTCRY
YQRDINADFNAAVNIAKKALNNTEVVTTLL    (SEQ ID NO: 37)

FIG. 1 (Cont.)

>CasZb.6|rifcsphigho2_02_scaffold_55589_5 transposase, IS605
OrfB family id=61682131 partial=0
scaf=rifcsphigho2_02_scaffold_55589 bin=RifCSPhighO2_02_full_UNK
sample=RIFCSPHIGHO2_02_FULL proj=RifleCSP2_HighO2
mARAKNQPYQKLTTTTGIKFKLDLSEEEGKRFDEYFSEYAKAVNFCAKVIYQLRKNLKFAGKKE
LAAKEWKFEISNCDFCNKQKEIYYKNIANGQKVCKGCHRTNFSDNAIRKKMIPVKGRKVESKFN
IHNTTKKISGTHRHWAFEDAADIIESMDKQRKEKQKRLRREKRKLSYFFELFGDPAKRYELPKV
GKQRVPRYLHKIIDKDSLTKKRGYSLSYIKNKIKISERNIERDEKSLRKASPIAFGARKIKMSK
LDPKRAFDLENNVFKIPGKVIKGQYKFFGTNVANEHGKKFYKDRISKILAGKPKYFYLLRKKVA
ESDGNPIFEYYVQWSIDTETPAITSYDNILGIDAGITNLATTVLIPKNLSAEHCSHCGNNHVKP
IFTKFFSGKELKAIKIKSRKQKYFLRGKHNKLVKIKRIRPIEQKVDGYCHVVSKQIVEMAKERN
SCIALEKLEKPKKSKFRQRRREKYAVSMFVFKKLATFIKYKAAREGIEIIPVEPEGTSYTCSHC
KNAQNNQRPYFKPNSKKSWTSMFKCGKCGIELNSDYNAAFNIAQKALNMTSA
    (SEQ ID NO: 38)

>CasZb.7|CG03_land_8_20_14_0.80_scaffold_2214_9 transposase,
IS605 OrfB family id=135165146 partial=0
scaf=CG03_land_8_20_14_0.80_scaffold_2214
bin=CG03_land_8_20_14_0_80_cor_UNK
sample=CG03_land_8_20_14_0_80_cor proj=Crystal Geyser
mDEKHFFCSYCNKELKISKNLINKISKGSIREDEAVSKAISIHNKKEHSLILGIKFKLFIENKL
DKKKLNEYFDNYSKAVTFAARIFDKIRSPYKFIGLKDKNTKKWTFPKAKCVFCLEEKEVAYANE
KDNSKICTECYLKEFGENGIRKKIYSTRGRKVEPKYNIFNSTKELSSTHYNYAIRDAFQLLDAL
KKQRQKKLKSIFNQKLRLKEFEDIFSDPQKRIELSLKPHQREKRYIHLSKSGQESINRGYTLRF
VRGKIKSLTRNIEREEKSLRKKTPIHFKGNRLMIFPAGIKFDFASNKVKISISKNLPNEFNFSG
TNVKNEHGKSFFKSRIELIKTQKPKYAYVLRKIKREYSKLRNYEIEKIRLENPNADLCDFYLQY
TIETESRNNEEINGIIGIDRGITNLACLVLLKKGDKKPSGVKFYKGNKILGMKIAYRKHLYLLK
GKRNKLRKQRQIRAIEPKINLILHQISKDIVKIAKEKNFAIALEQLEKPKKARFAQRKKEKYKL
ALFTFKNLSTLIEYKSKREGIPVIYVPPEKTSQMCSHCAINGDEHVDTQRPYKKPNAQKPSYSL
FKCNKCGIELNADYNAAFNIAQKGLKTLMLNHSH    (SEQ ID NO: 39)

>CasZb.8|058|3300002172.a:JGI24730J26740_1002785_01697
Zr6.newTrpA
MLQTLLVKLDPSKEQYKMLYETMERFNEACNQIAETVFAIHSANKIEVQKTVYYPIREKFGLSA
QLTILAIRKVCEAYKRDKSIKPEFRLDGALVYDQRVLSWKGLDKVSLVTLQGRQIIPIKFGDYQ
KARMDRIRGQADLILVKGVFYLCVVVEVSEESPYDPKGVLGVDLGIKNLAVDSDGEVHSGEQTT
NTRERLDSLKARLQSKGTKSAKRHLKKLSGRMAKFSKDVNHCISKKLVAKAKGTLMSIALEDLQ
GIRDRVTVRKAQRRNLHTWNFGLLRMFVDYKAKIAGVPLVFVDPRNTSRTCPSCGHVAKANRPT
RDEFRCVSCGFAGAADHIAAMNIAFRAEVSQPIVTRFFVQSQAPSFRVG
    (SEQ ID NO: 40)

FIG. 1 (Cont.)

>CasZb.9|114|3300013125.a:Ga0172369_10000737_00842
Zr6.cluA_2b.c10_like protein
MDEEPDSAEPNLAPISVKLKLVKLDGEKLAALNDYFNEYAKAVNFCELKMQKIRKNLVNIRGTY
LKEKKAWINQTGECCICKKIDELRCEDKNPDINGKICKKCYNGRYGNQMIRKLFVSTNKRAVPK
SLDIRKVARLHNTHYHRIPPEAADIIKAIETAERKRRNRILFDERRYNELKDALENEEKRVARP
KKPKEREVRYVPISKKDTPSKGYTMNALVRKVSGMAKKIERAKRNLNKRKKIEYLGRRILLDKN
WVRFDFDKSEISIPTMKEFFGEMRFEITGPSNVMSPNGREYFTKWFDRIKAQPDNYCYLLRKES
EDETDFYLQYTWRPDAHPKKDYTGCLGIDIGGSKLASAVYFDADKNRAKQPIQIFSNPIGKWKT
KRQKVIKVLSKAAVRHKTKKLESLRNIEPRIDVHCHRIARKIVGMALAANAFISMENLEGGIRE
KQKAKETKKQKFSRNMFVFRKLSKLIEYKALMEGVKVVYIVPDYTSQLCSSCGTNNTKRPKQAI

FMCQNTECRYFGKNINADFNAAINIAKKALNRKDIVRELS (SEQ ID NO: 44)

>CasZb.10|115|3300013125.a:Ga0172369_10010464_01540
Zr6.cluA_2b.c10_like protein
MEKNNSEQTSITTGIKFKLKLDKETKEKLNNYFDEYGKAINFAVRIIQMQLNDDRLAGKYKRDE
KGKPILGEDGKKILEIPNDFCSCGNQVNHYVNGVSFCQECYKKRFSENGIRKRMYSAKGRKAEQ
DINIKNSTNKISKTHFNYAIREAFNLDKSIKKQREKRFKKLKDMKRKLQEFLEIRDGKRVICPK
IEKQKVERYIHPSWINKEKKLEEFRGYSLSIVNSKIKSFDRNIQREEKSLKEKGQINFKAQRLM
LDKSVKFLKDNKVSFTISKELPKTFELDLPKKEKKLNWLNEKLEIIKNQKPKYAYLLRKENNIF
LQYTLDSIPEIHSEYSGAVGIDRGVSHIAVYTFLDKDGKNERPFFLSSSGILRLKNLQKERDKF
LRKKHNKIRKKGNMRNIEQKINLILHEYSKQIVNFAKDKNAFIVFELLEKPKKSRERMSKKIQY
KLSQFTFKKLSDLVDYKAKREGIKVIYVEPAYTSKDCSHCGERVNTQRPFNGNFSLFKCNKCGI

VLNSDYNASLNIARKGLNISAN (SEQ ID NO: 45)

>CasZb.11|134|3300013127.a:Ga0172365_10004421_00828
Zr6.cluA_2b.c10_like protein
MAEEKFFFCEKCNKDIKIPKNYINKQGAEEKARAKHEHRVHALILGIKFKIYPKKEDISKLNDY
FDEYAKAVTFTAKIVDKLKAPFLFAGKRDKDTSKKKWVFPVDKCSFCKEKTEINYRTKQGKNIC
NSCYLTEFGEQGLLEKIYATKGRKVSSSFNLFNSTKKLTGTHNNYVVKESLQLLDALKKQRSKR
LKKLSNTRRKLKQFEEMFEKEDKRFQLPLKEKQRELRFIHVSQKDRATEFKGYTMNKIKSKIKV
LRRNIEREQRSLNRKSPVFFRGTRIRLSPSVQFDDKDNKIKLTLSKELPKEYSFSGLNVANEHG
RKFFAEKLKLIKENKSKYAYLLRRQVNKNNKKPIYDYYLQYTVEFLPNIITNYNGILGIDRGIN
TLACIVLLENKKEKPSFVKFFSGKGILNLKNKRRQLYFLKGVHNKYRKQQKIRPIEPRIDQIL
HDISKQIIDLAKEKRVAISLEQLEKPQKPKFRQSRKAKYKLSQFNFKTLSNYIDYKAKKEGIRV
IYIAPEMTSQNCSRCAMKNDLHVNTQRPYKNTSSLFKCNKCGVELNADYNAAFNIAQKGLKILN

S (SEQ ID NO: 46)

FIG. 1 (Cont.)

CasZc

>CasZc.1|CG08_land_8_20_14_0.20_scaffold_1609_10 Tax=CG_Micra_03
id=133381002 partial=0 scaf=CG08_land_8_20_14_0.20_scaffold_1609
bin=CG08_land_8_20_14_0_20_UNK sample=CG08_land_8_20_14_0_20
proj=Crystal Geyser
mISLKLKLLPDEEQKKLLDEMFWKWASICTRVGFGRADKEDLKPPKDAEGVWFSLTQLNQANTD
INDLREAMKHQKHRLEYEKNRLEAQRDDTQDALKNPDRREISTKRKDLFRPKASVEKGFLKLKY
HQERYWVRRLKEINKLIERKTKTLIKIEKGRIKFKATRITLHQGSFKIRFGDKPAFLIKALSGK
NQIDAPFVVVPEQPICGSVVNSKKYLDEITTNFLAYSVNAMLFGLSRSEEMLLKAKRPEKIKKK
EEKLAKKQSAFENKKKELQKLLGRELTQQEEAIIEETRNQFFQDFEVKITKQYSELLSKIANEL
KQKNDFLKVNKYPILLRKPLKKAKSKKINNLSPSEWKYYLQFGVKPLLKQKSRRKSRNVLGIDR
GLKHLLAVTVLEPDKKTFVWNKLYPNPITGWKWRRRKLLRSLKRLKRRIKSQKHETIHENQTRK
KLKSLQGRIDDLLHNISRKIVETAKEYDAVIVVEDLQSMRQHGRSKGNRLKTLNYALSLFDYAN
VMQLIKYKAGIEGIQIYDVKPAGTSQNCAYCLLAQRDSHEYKRSQENSKIGVCLNPNCQNHKKQ
IDADLNAARVIASCYALKINDSQPFGTRKRFKKRTTN (SEQ ID NO: 47)

>CasZc.2|CG_4_10_14_0.8_um_filter_scaffold_20762_4
Tax=CG_Micra_03 id=144037526 partial=0
scaf=CG_4_10_14_0.8_um_filter_scaffold_20762
bin=CG_4_10_14_0_8_um_filter_cor_UNK
sample=CG_4_10_14_0_8_um_filter_cor proj=Crystal Geyser
mETLSLKLKLNPSKEQLLVLDKMFWKWASICTRLGLKKAEMSDLEPPKDAEGVWFSKTQLNQAN
TDVNDLRKAMQHQGKRIEYELDKVENRRNEIQEMLEKPDRRDISPNRKDLFRPKAAVEKGYLKL
KYHKLGYWSKELKTANKLIERKRKTLAKIDAGKMKFKPTRISLHTNSFRIKFGEEPKIALSTTS
KHEKIELPLITSLQRPLKTSCAKKSKTYLDAAILNFLAYSTNAALFGLSRSEEMLLKAKKPEKI
EKRDRKLATKRESFDKKLKTLEKLLERKLSEKEKSVFKRKQTEFFDKFCITLDETYVEALHRIA
EELVSKNKYLEIKKYPVLLRKPESRLRSKKLKNLKPEDWTYYIQFGFQPLLDTPKPIKTKTVLG
IDRGVRHLLAVSIFDPRTKTFTFNRLYSNPIVDWKWRRRKLLRSIKRLKRRLKSEKHVHLHENQ
FKAKLRSLEGRIEDHFHNLSKEIVDLAKENNSVIVVENLGGMRQHGRGRGKWLKALNYALSHFD
YAKVMQLIKYKAELAGVFVYDVAPAGTSINCAYCLLNDKDASNYTRGKVINGKKNTKIGECKTC
KKEFDADLNAARVIALCYEKRLNDPQPFGTRKQFKPKKP (SEQ ID NO: 48)

FIG. 1 (Cont.)

>CasZc.3|CG22_combo_CG10-13_8_21_14_all_scaffold_2003_2 IS605
OrfB family transposase id=130740989 partial=0
scaf=CG22_combo_CG10-13_8_21_14_all_scaffold_2003
bin=CG22_combo_CG10-13_8_21_14_all_UNK sample=CG22_combo_CG10-
13_8_21_14_all proj=Crystal Geyser
mKALKLQLIPTRKQYKILDEMFWKWASLANRVSQKGESKETLAPKKDIQKIQFNATQLNQIEKD
IKDLRGAMKEQQKQKERLLLQIQERRSTISEMLNDDNNKERDPHRPLNFRPKGWRKFHTSKHWV
GELSKILRQEDRVKKTIERIVAGKISFKPKRIGIWSSNYKINFFKRKISINPLNSKGFELTLMT
EPTQDLIGKNGGKSVLNNKRYLDDSIKSLLMFALHSRFFGLNNTDTYLLGGKINPSLVKYYKKN
QDMGEFGREIVEKFERKLKQEINEQQKKIIMSQIKEQYSNRDSAFNKDYLGLINEFSEVFNQRK
SERAEYLLDSFEDKIKQIKQEIGESLNISDWDFLIDEAKKAYGYEEGFTEYVYSKRYLEILNKI
VKAVLITDIYFDLRKYPILLRKPLDKIKKISNLKPDEWSYYIQFGYDSINPVQLMSTDKFLGID
RGLTHLLAYSVFDKEKKEFIINQLEPNPIMGWKWKLRKVKRSLQHLERRIRAQKMVKLPENQMK
KKLKSIEPKIEVHYHNISRKIVNLAKDYNASIVVESLEGGGLKQHGRKKNARNRSLNYALSLFD
YGKIASLIKYKADLEGVPMYEVLPAYTSQQCAKCVLEKGSFVDPEIIGYVEDIGIKGSLLDSLF
EGTELSSIQVLKKIKNKIELSARDNHNKEINLILKYNFKGLVIVRGQDKEEIAEHPIKEINGKF
AILDFVYKRGKEKVGKKGNQKVRYTGNKKVGYCSKHGQVDADLNASRVIALCKYLDINDPILFG

EQRKSFK (SEQ ID NO: 49)

>CasZc.4|rifcsphigho2_01_scaffold_82367_2 Tax=CG_Micra_03
id=56177664 partial=0 scaf=rifcsphigho2_01_scaffold_82367
bin=RifCSPhighO2_01_full_UNK sample=RIFCSPHIGHO2_01_FULL
proj=RifleCSP2_HighO2
mVTRAIKLKLDPTKNQYKLLNEMFWKWASLANRFSQKGASKETLAPKDGTQKIQFNATQLNQIK
KDVDDLRGAMEKQGKQKERLLIQIQERLLTISEILRDDSKKEKDPHRPQNFRPFGWRRFHTSAY
WSSEASKLTRQVDRVRRTIERIKAGKINFKPKRIGLWSSTYKINFLKKKINISPLKSKSFELDL
ITEPQQKIIGKEGGKSVANSKKYLDDSIKSLLIFAIKSRLFGLNNKDKPLFENIITPNLVRYHK
KGQEQENFKKEVIKKFENKLKKEISQKQKEIIFSQIERQYENRDATFSEDYLRAISEFSEIFNQ
RKKERAKELLNSFNEKIRQLKKEVNGNISEEDLKILEVEAEKAYNYENGFIEWEYSEQFLGVLE
KIARAVLISDNYFDLKKYPILIRKPTNKSKKITNLKPEEWDYYIQFGYGLINSPMKIETKNFMG
IDRGLTHLLAYSIFDRDSEKFTINQLELNPIKGWKWKLRKVKRSLQHLERRMRAQKGVKLPENQ
MKKRLKSIEPKIESYYHNLSRKIVNLAKANNASIVVESLEGGGLKQHGRKKNSRHRALNYALSL
FDYGKIASLIKYKSDLEGVPMYEVLPAYTSQQCAKCVLKKGSFVEPEIIGYIEEIGFKENLLTL
LFEDTGLSSVQVLKKSKNKMTLSARDKEGKMVDLVLKYNFKGLVISQEKKKEEIVEFPIKEIDG
KFAVLDSAYKRGKERISKKGNQKLVYTGNKKVGYCSVHGQVDADLNASRVIALCKYLGINEPIV

FGEQRKSFK (SEQ ID NO: 50)

FIG. 1 (Cont.)

\>CasZc.5|gwc1_scaffold_8732_6 Transposase, IS605 OrfB family
id=3520800 partial=0 scaf=gwc1_scaffold_8732 bin=GWC1 Unbinned
sample=GWC1 proj=Rifle Groundwater Metagenome
LDLITEPIQPHKSSSLRSKEFLEYQISDFLNFSLHSLFFGLASNEGPLVDFKIYDKIVIPKPEE
RFPKKESEEGKKLDSFDKRVEEYYSDKLEKKIERKLNTEEKNVIDREKTRIWGEVNKLEEIRSI
IDEINEIKKQKHISEKSKLLGEKWKKVNNIQETLLSQEYVSLISNLSDELTNKKKELLAKKYSK
FDDKIKKIKEDYGLEFDENTIKKEGEKAFLNPDKFSKYQFSSSYLKLIGEIARSLITYKGFLDL
NKYPIIFRKPINKVKKIHNLEPDEWKYYIQFGYEQINNPKLETENILGIDRGLTHILAYSVFEP
RSSKFILNKLEPNPIEGWKWKLRKLRRSIQNLERRWRAQDNVKLPENQMKKNLRSIEDKVENLY
HNLSRKIVDLAKEKNACIVFEKLEGQGMKQHGRKKSDRLRGLNYKLSLFDYGKIAKLIKYKAEI
EGIPIYRIDSAYTSQNCAKCVLESRRFAQPEEISCLDDFKEGDNLDKRILEGTGLVEAKIYKKL
LKEKKEDFEIEEDIAMFDTKKVIKENKEKTVILDYVYTRRKEIIGTNHKKNIKGIAKYTGNTKI

GYCMKHGQVDADLNASRTIALCKNFDINNPEIWK     (SEQ ID NO: 59)

\>CasZc.6|109|3300010293.a:Ga0116204_1008574_00822
Zr6.cluA_2a.c10_like protein
MSDESLVSSEDKLAIKIKIVPNAEQAKMLDEMFKKWSSICNRISRGKEDIETLRPDEGKELQFN
STQLNSATMDVSDLKKAMARQGERLEAEVSKLRGRYETIDASLRDPSRRHTNPQKPSSFYPSDW
DISGRLTPRFHTARHYSTELRKLKAKEDKMLKTINKIKNGKIVFKPKRITLWPSSVNMAFKGSR
LLLKPFANGFEMELPIVISPQKTADGKSQKASAEYMRNALLGLAGYSINQLLFGMNRSQKMLAN
AKKPEKVEKFLEQMKNKDANFDKKIKALEGKWLLDRKLKESEKSSIAVVRTKFFKSGKVELNED
YLKLLKHMANEILERDGFVNLNKYPILSRKPMKRYKQKNIDNLKPNMWKYYIQFGYEPIFERKA
SGKPKNIMGIDRGLTHLLAVAVFSPDQQKFLFNHLESNPIMHWKWKLRKIRRSIQHMERRIRAE
KNKHIHEAQLKKRLGSIEEKTEQHYHIVSSKIINWAIEYEAAIVLESLSHMKQRGGKKSVRTRA
LNYALSLFDYEKVARLITYKARIRGIPVYDVLPGMTSKTCATCLLNGSQGAYVRGLETTKAAGK
ATKRKNMKIGKCMVCNSSENSMIDADLNAARVIAICKYKNLNDPQPAGSRKVFKRF
     (SEQ ID NO:256)

\>CasZc.7|126|3300005573.a:Ga0078972_1001015_00056
Zr6.cluA_2a.c10_like protein
MLALKLKIMPTEKQAEILDAMFWKWASICSRIAKMKKKVSVKENKKELSKKIPSNSDIWFSKTQ
LCQAEVDVGDHKKALKNFEKRQESLLDELKYKVKAINEVINDESKREIDPNNPSKFRIKDSTKK
GNLNSPKFFTLKKWQKILQENEKRIKKKESTIEKLKRGNIFFNPTKISLHEEEYSINFGSSKLL
LNCFYKYNKKSGINSDQLENKFNEFQNGLNIICSPLQPIRGSSKRSFEFIRNSIINFLMYSLYA
KLFGIPRSVKALMKSNKDENKLKLEEKLKKKKSSFNKTVKEFEKMIGRKLSDNESKILNDESKK
FFEIIKSNNKYIPSEEYLKLLKDISEEIYNSNIDFKPYKYSILIRKPLSKFKSKKLYNLKPTDY
KYYLQLSYEPFSKQLIATKTILGIDRGLKHLLAVSVFDPSQNKFVYNKLIKNPVFKWKKRYHDL
KRSIRNRERRIRALTGVHIHENQLIKKLKSMKNKINVLYHNVSKNIVDLAKKYESTIVLERLEN
LKQHGRSKGKRYKKLNYVLSNFDYKKIESLISYKAKKEGVPVSNINPKYTSKTCAKCLLEVNQL
SELKNEYNRDSKNSKIGICNIHGQIDADLNAARVIALCYSKNLNEPHFK
     (SEQ ID NO: 60)

FIG. 1 (Cont.)

*CasZd*

>CasZd.1|CG10_big_fil_rev_8_21_14_0.10_scaffold_4477_25 IS605
OrfB family transposase id=132383911 partial=0
scaf=CG10_big_fil_rev_8_21_14_0.10_scaffold_4477
bin=CG10_big_fil_rev_8_21_14_0_10_test2
sample=CG10_big_fil_rev_8_21_14_0_10 proj=Crystal Geyser
VINLFGYKFALYPNKTQEELLNKHLGECGWLYNKAIEQNEYYKADSNIEEAQKKFELLPDKNSD
EAKVLRGNISKDNYVYRTLVKKKKSEINVQIRKAVVLRPAETIRNLAKVKKKGLSVGRLKFIPI
REWDVLPFKQSDQIRLEENYLILEPYGRLKFKMHRPLLGKPKTFCIKRTATDRWTISFSTEYDD
SNMRKNDGGQVGIDVGLKTHLRLSNENPDEDPRYPNPKIWKRYDRRLTILQRRISKSKKLGKNR
TRLRLRLSRLWEKIRNSRADLIQNETYEILSENKLIAIEDLNVKGMQEKKDKKGRKGRTRAQEK
GLHRSISDAAFSEFRRVLEYKAKRFGSEVKPVSAIDSSKECHNCGNKKGMPLESRIYECPKCGL
KIDRDLNSAKVILARATGVRPGSNARADTKISATAGASVQTEGTVSEDFRQQMETSDQKPMQGE
GSKEPPMNPEHKSSGRGSKHVNIGCKNKVGLYNEDENSRSTEKQIMDENRSTTEDMVEIGALHS
PVLTT (SEQ ID NO: 61)

>CasZd.2|053|3300001245.a:JGI12048J13642_10201286_01511
Zr6.c9.inclusive
MIASIDYEAVSQALIVFEFKAKGKDSQYQAIDEAIRSYRFIRNSCLRYWMDNKKVGKYDLNKYC
KVLAKQYPFANKLNSQARQSAAECSWSAISRFYDNCKRKVSGKKGFPKFKKHARSVEYKTSGWK
LSENRKAITFTDKNGIGKLKLKGTYDLHFSQLEDMKRVRLVRRADGYYVQFCISVDVKVETEPT
GKAIGLDVGIKYFLADSSGNTIENPQFYRKAEKKLNRANRRKSKKYIRGVKPQSKNYHKARCRY
ARKHLRVSRQRKEYCKRVAYCVIHSNDVVAYEDLNVKGMVKNRHLAKSISDVAWSTFRHWLEYF
AIKYGKLTIPVAPHNTSQNCSNCDKKVPKSLSTRTHICHHCGYSEDRDVNAAKNILKKALSTVG
QTGSLKLGEIEPLLVLEQSCTRKFDL (SEQ ID NO: 62)

*CasZe*

>CasZe.1|19ft_2_nophage_noknown_scaffold_0_545 \N id=8269792
partial=0 scaf=19ft_2_nophage_noknown_scaffold_0 bin=19ft_2_UNK
sample=19FT_2_THINNED proj=Rifle Sediment CSP1
LAEENTLHLTLAMSLPLNDLPENRTRSELWRRQWLPQKKLSLLLGVNQSVRKAAADCLRWFEPY
QELLWWEPTDPDGKKLLDKEGRPIKRTAGHMRVLRKLEEIAPFRGYQLGSAVKNGLRHKVADLL
LSYAKRKLDPQFTDKTSYPSIGDQFPIVWTGAFVCYEQSITGQLYLYLPLFPRGSHQEDITNNY
DPDRGPALQVFGEKEIARLSRSTSGLLLPLQFDKWGEATFIRGENNPPTWKATHRRSDKKWLSE
VLLREKDFQPKRVELLVRNGRIFVNVACEIPTKPLLEVENFMGVSFGLEHLVTVVVINRDGNVV
HQRQEPARRYEKTYFARLERLRRGGPFSQELETFHYRQVAQIVEEALRFKSVPAVEQVGNIPK
GRYNPRLNLRLSYWPFGKLADLTSYKAVKEGLPKPYSVYSATAKMLCSTCGAANKEGDQPISLK
GPTVYCGNCGTRHNTGFNTALNLARRAQELFVKGVVAR (SEQ ID NO: 63)

FIG. 1 (Cont.)

>CasZe.2|RIFCSPHIGHO2_01_FULL_CPR_46_36_rifcsphigho2_01_scaffold
_646_49 Tax=RIFCSPHIGHO2_01_FULL_RIF_OD1_04_46_36_curated
Id=87353177 partial=0
scaf=RIFCSPHIGHO2_01_FULL_CPR_46_36_rifcsphigho2_01_scaffold_646
bin=RIFCSPHIGHO2_01_FULL_OD1_Andersenbacteria_46_36_curated
sample=2500-curated-genomes-non-redundant proj=2500_Genomes
mSQSLLKWHDMAGRDKDASRSLQKSAVEGVLLHLTASHRVALEMLEKSVSQTVAVTMEAAQQRL
VIVLEDDPTKATSRKRVISADLQFTREEFGSLPNWAQKLASTCPEIATKYADKHINSIRIAWGV
AKESTNGDAVEQKLQWQIRLLDVTMFLQQLVLQLADKALLEQIPSSIRGGIGQEVAQQVTSHIQ
LLDSGTVLKAELPTISDRNSELARKQWEDAIQTVCTYALPFSRERARILDPGKYAAEDPRGDRL
INIDPMWARVLKGPTVKSLPLLFVSGSSIRIVKLTLPRKHAAGHKHTFTATYLVLPVSREWINS
LPGTVQEKVQWWKKPDVLATQELLVGKGALKKSANTLVIPISAGKKRFFNHILPALQRGFPLQW
QRIVGRSYRRPATHRKWFAQLTIGYTNPSSLPEMALGIHFGMKDILWWALADKQGNILKDGSIP
GNSILDFSLQEKGKIERQQKAGKNVAGKKYGKSLLNATYRVVNGVLEFSKGISAEHASQPIGLG
LETIRFVDKASGSSPVNARHSNWNYGQLSGIFANKAGPAGFSVTEITLKKAQRDLSDAEQARVL
AIEATKRFASRIKRLATKRKDDTLFV (SEQ ID NO: 64)

>CasZe.3|rifcsphigho2_01_scaffold_10981_6
Tax=RIFCSPHIGHO2_01_FULL_OD1_47_10b curated id=55513311
partial=0 scaf=rifcsphigho2_01_scaffold_10981
bin=RIFCSPHIGHO2_01_FULL_OD1_47_10b sample=2500-genomes
proj=2500_Genomes
VEPVEKERFYYRTYTFRLDGQPRTQNLTTQSGWGLLTKAVLDNTKHYWEIVHHARIANQPIVFE
NPVIDEQGNPKLNKLGQPRFWKRPISDIVNQLRALFENQNPYQLGSSLIQGTYWDVAENLASWY
ALNKEYLAGTATWGEPSFPEPHPLTEINQWMPLTFSSGKVVRLLKNASGRYFIGLPILGENNPC
YRMRTIEKLIPCDGKGRVTSGSLILFPLVGIYAQQHRRMTDICESIRTEKGKLAWAQVSIDYVR
EVDKRRRMRRTRKSQGWIQGPWQEVFILRLVLAHKAPKLYKPRCFAGISLGPKTLASCVILDQD
ERVVEKQQWSGSELLSLIHQGEERLRSLREQSKPTWNAAYRKQLKSLINTQVFTIVTFLRERGA
AVRLESIARVRKSTPAPPVNFLLSHWAYRQITERLKDLAIRNGMPLTHSNGSYGVRFTCSQCGA
TNQGIKDPTKYKVDIESETFLCSICSHREIAAVNTATNLAKQLLDE (SEQ ID NO: 65)

>CasZe.4b|rifcsplowo2_02_scaffold_57876_2 hypothetical protein
Tax=GWA2_OD1_56_11 id=66016044 partial=0
scaf=rifcsplowo2_02_scaffold_57876 bin=RifCSPlowO2_02_full_UNK
sample=RIFCSPLOWO2_02_FULL proj=RifleCSP2_LowO2
mNDTETSETLTSHRTVCAHLHVVGETGSLPRLVEAALAELITLNGRATQALLSLAKNGLVLRRD
KEENLIAAELTLPCRKNKYADVAAKAGEPILATRINNKGKLVTKKWYGEGNSYHIVRFTPETGM
FTVRVFDRYAFDEELLHLHSEVVFGSDLPKGIKAKTDSLPANFLQAVFTSFLELPFQGFPDIVV
KPAMKQAAEQLLSYVQLEAGENQQAEYPDTNERDPELRLVEWQKSLHELSVRTEPFEFVRARDI
DYYAETDRRGNRFVNITPEWTKFAESPFARRLPLKIPPEFCILLRRKTEGHAKIPNRIYLGLQI
FDGVTPDSTLGVLATAEDGKLFWWHDHLDEFSNLEGKPEPKLKNKPQLLMVSLEYDREQRFEES
VGGDRKICLVTLKETRNFRRGWNGRILGIHFQHNPVITWALMDHDAEVLEKGFIEGNAFLGKAL
DKQALNEYLQKGGKWVGDRSFGNKLKGITHTLASLIVRLAREKDAWIALEEISWVQKQSADSVA
NHEIVEQPHHSLTR (SEQ ID NO: 66)

FIG. 1 (Cont.)

\>CasZe.4|RIFCSPLOWO2_01_FULL_OD1_45_34b_rifcsplowo2_01_scaffold_
3495_33 hypothetical protein Tax=GWA2_OD1_56_11 id=88324948
partial=0
scaf=RIFCSPLOWO2_01_FULL_OD1_45_34b_rifcsplowo2_01_scaffold_3495
bin=RIFCSPLOWO2_01_FULL_OD1_Taylorbacteria_45_34b_curated
sample=2500-curated-genomes proj=2500 Genomes
mNDTETSETLTSHRTVCAHLHVVGETGSLPRLVEAALAELITLNGRATQALLSLAKNGLVLRRD
KEENLIAAELTLPCRKNKYADVAAKAGEPILATRINNKGKLVTKKWYGEGNSYHIVRFTPETGM
FTVRVFDRYAFDEELLHLHSEVVFGSDLPKGIKAKTDSLPANFLQAVFTSFLELPFQGFPDIVV
KPAMKQAAEQLLSYVQLEAGENQQAEYPDTNERDPELRLVEWQKSLHELSVRTEPFEFVRARDI
DYYAETDRRGNRFVNITPEWTKFAESPFARRLPLKIPPEFCILLRRKTEGHAKIPNRIYLGLQI
FDGVTPDSTLGVLATAEDGKLFWWHDHLDEFSNLEGKPEPKLKNKPQLLMVSLEYDREQRFEES
VGGDRKICLVTLKETRNFRRGRHGHTRTDRLPAGNTLWRADFATSAEVAAPKWNGRILGIHFQH
NPVITWALMDHDAEVLEKGFIEGNAFLGKALDKQALNEYLQKGGKWVGDRSFGNKLKGITHTLA
SLIVRLAREKDAWIALEEISWVQKQSADSVANRRFSMWNYSRLATLIEWLGTDIATRDCGTAAP
LAHKVSDYLTHFTCPECGACRKAGQKKEIADTVRAGDILTCRKCGFSGPIPDNFIAEFVAKKAL

ERMLKKKPV (SEQ ID NO: 67)

*CasZf*

\>CasZf.1|rifcsphigho2_01_scaffold_566_121
Tax=RIFCSPHIGHO2_01_FULL_RIF_OD1_10_44_22b_curated id=55167017
partial=0 scaf=rifcsphigho2_01_scaffold_566
bin=RifCSPhighO2_01_full_UNK sample=RIFCSPHIGHO2_01_FULL
proj=RifleCSP2_HighO2
mAKRNFGEKSEALYRAVRFEVRPSKEELSILLAVSEVLRMLFNSALAERQQVFTEFIASLYAEL
KSASVPEEISEIRKKLREAYKEHSISLFDQINALTARRVEDEAFASVTRNWQEETLDALDGAYK
SFLSLRRKGDYDAHSPRSRDSGFFQKIPGRSGFKIGEGRIALSCGAGRKLSFPIPDYQQGRLAE
TTKLKKFELYRDQPNLAKSGRFWISVVYELPKPEATTCQSEQVAFVALGASSIGVVSQRGEEVI
ALWRSDKHWVPKIEAVEERMKRRVKGSRGWLRLLNSGKRRMHMISSRQHVQDEREIVDYLVRNH
GSHFVVTELVVRSKEGKLADSSKPERGGSLGLNWAAQNTGSLSRLVRQLEEKVKEHGGSVRKHK

LTLTEAPPARGAENKLWMARKLRESFLKEV (SEQ ID NO: 68)

\>CasZf.2|rifcsplowo2_01_scaffold_81231_1 transposase, IS605 OrfB
family, central region Id=58737995 partial=0
scaf=rifcsplowo2_01_scaffold_81231 bin=RifCSPlowO2_01_full_UNK
sample=RIFCSPLOWO2_01_FULL proj=RifleCSP2_LowO2
LAKNDEKELLYQSVKFEIYPDESKIRVLTRVSNILVLVWNSALGERRARFELYIAPLYEELKKF
PRKSAESNALRQKIREGYKEHIPTFFDQLKKLLTPMRKEDPALLGSVPRAYQEETLNTLNGSFV
SFMTLRRNNDMDAKPPKGRAEDRFHEISGRSGFKIDGSEFVLSTKEQKLRFPIPNYQLEKLKEA
KQIKKFTLYQSRDRRFWISIAYEIELPDQRPFNPEEVIYIAFGASSIGVISPEGEKVIDFWRPD
KHWKPKIKEVENRMRSCKKGSRAWKKRAAARRKMYAMTQRQQKLNHREIVASLLRLGFHFVVTE
YTVRSKPGKLADGSNPKRGGAPQGFNWSAQNTGSFGEFILWLKQKVKEQGGTVQTFRLVLGQSE

RPEKRGRDNKIEMVRLLREKYLESQTIVV (SEQ ID NO: 69)

FIG. 1 (Cont.)

>CasZf.3|rifcsphigho2_01_scaffold_4702_81 IS605 OrfB family transposase id=55366684 partial=0 scaf=rifcsphigho2_01_scaffold_4702 bin=RifCSPhighO2_01_full_UNK sample=RIFCSPHIGHO2_01_FULL proj=RifleCSP2_HighO2
mAKGKKKEGKPLYRAVRFEIFPTSDQITLFLRVSKNLQQVWNEAWQERQSCYEQFFGSIYERIG
QAKKRAQEAGFSEVWENEAKKGLNKKLRQQEISMQLVSEKESLLQELSIAFQEHGVTLYDQING
LTARRIIGEFALIPRNWQEETLDSLDGSFKSFLALRKNGDPDAKPPRQRVSENSFYKIPGRSGF
KVSNGQIYLSFGKIGQTLTSVIPEFQLKRLETAIKLKKFELCRDERDMAKPGRFWISVAYEIPK
PEKVPVVSKQITYLAIGASRLGVVSPKGEFCLNLPRSDYHWKPQINALQERLEGVVKGSRKWKK
RMAACTRMFAKLGHQQKQHGQYEVVKKLLRHGVHFVVTELKVRSKPGALADASKSDRKGSPTGP
NWSAQNTGNIARLIQKLTDKASEHGGTVIKRNPPLLSLEERQLPDAQRKIFIAKKLREEFLADQ
K (SEQ ID NO: 70)

CasZg

>CasZg.1|rifcsp13_1_sub10_scaffold_3_54 \N id=12787801 partial=0 scaf=rifcsp13_1_sub10_scaffold_3 bin=RifCSP13_1_UNK sample=RIFCSP13_1 proj=Rifle Sediment CSP2
mAKREKKDDVVLRGTKMRIYPTDRQVTLMDWRRRCISLWNLLLNLETAAYGAKNTRSKLGWRS
IWARVVEENHAKALIVYQHGKCKKDGSFVLKRDGTVKHPPRERFPGDRKILLGLFDALRHTLDK
GAKCKCNVQPYALTRAWLDETGHGARTADIIAWLKDFKGECDCTAISTAAKYCPAPPTAELLT
KIKRAAPADDLPVDQAILLDLFGALRGGLKQKECDHTHARTVAYFEKHELAGRAEDILAWLIAH
GGTCDCKIVEEAANHCPGPRLFIWEHELAMIMARLKAEPRTEWIGDLPSHAAQTVVKDLVKALQ
TMLKERAKAAAGDESARKTGFPKFKKQAYAAGSVYFPNTTmFFDVAAGRVQLPNGCGSMRCEIP
RQLVAELLERNLKPGLVIGAQLGLLGGRIWRQGDRWYLSCQWERPQPTLLPKTGRTAGVKIAAS
IVFTTYDNRGQTKEYPMPPADKKLTAVHLVAGKQNSRALEAQKEKEKKLKARKERLRLGKLEKG
HDPNALKPLKRPRVRRSKLFYKSAARLAACEAIERDRRDGFLHRVTNEIVHKFDAVSVQKMSVA
PMMRRQKQKEKQIESKKNEAKKEDNGAAKKPRNLKPVRKLLRHVAMARGRQFLEYKYNDLRGPG
SVLIADRLEPEVQECSRCGTKNPQMKDGRRLLRCIGVLPDGTDCDAVLPRNRNAARNAEKRLRK
HREAHNA (SEQ ID NO: 71)

>CasZg.2|033|3300009991.a:Ga0105042_100140_01533 Zr6.c9.inclusive
MNEVLPIPAVGEDAADTIMRGSKMRIYPSVRQAATMDLWRRRCIQLWNLLLELEQAAYSGENRR
TQIGWRSIWATVVEDSHAEAVRVAREGKKRKDGTFRKAPSGKEIPPLDPAMLAKIQRQMNGAVD
VDPKTGEVTPAQPRLFMWEHELQKIMARLQAPRTHWIDDLPSHAAQSVVKDLIKALQAMLRER
KKRASGIGGRDTGFPKFKKNRYAAGSVYFANTQLRFEAKRGKAGDPDAVRGEFARVKLPNGVGW
MECRMPRHINAAHAYAQATLMGGRIWRQGENWYLSCQWKMPKPAPLPRAGRTAAIKIAAAIPIT
TVDNRGQTREYAMPPIDRERIAAHAAAGRAQSRALEARKRRAKKREAYAKKRHAKKLERGIAAK
PPGRARIKLSPGFYAAAAKLAKLEAEDANAREAWLHEITTQIVRNFDVIAVPRMEVAKLMKKPE
PPEEKEEQVKAPWQGKRRSLKAARVMMRRTAMALIQTTLKYKAVDLRGPQAYEEIAPLDVTAAA
CSGCGVLKPEWKMARAKGREIMRCQEPLPGGKTCNTVLTYTRNSARVIGRELAVRLAERQKA
(SEQ ID NO: 72)

FIG. 1 (Cont.)

CasZh

>CasZh.1|rifcsp2_19_4_full_scaffold_168_120 transposase
id=102318404 partial=0 scaf=rifcsp2_19_4_full_scaffold_168
bin=RifCSP19_4_full_UNK sample=RIFCSP19_4_FULL proj=Rifle
Sediment CSP1
mTTQKTYNFCFYDQRFFELSKEAGEVYSRSLEEFWKIYDETGVWLSKFDLQKHMRNKLERKLLH
SDSFLGAMQQVHANLASWKQAKKVVPDACPPRKPKFLQAILFKKSQIKYKNGFLRLTLGTEKEF
LYLKWDINIPLPIYGSVTYSKTRGWKINLCLETEVEQKNLSENKYLSIDLGVKRVATIFDGENT
ITLSGKKFMGLMHYRNKLNGKTQSRLSHKKKGSNNYKKIQRAKRKTTDRLLNIQKEMLHKYSSF
IVNYAIRNDIGNIIIGDNSSTHDSPNMRGKTNQKISQNPEQKLKNYIKYKFESISGRVDIVPEP
YTSRKCPHCKNIKKSSPKGRTYKCKKCGFIFDRDGVGAINIYNENVSFGQIISPGRIRSLTEPI
GMKFHNEIYFKSYVAA   (SEQ ID NO: 73)

CasZi

>CasZi.1|RBG_13_scaffold_1401_19
Tax=RBG_13_Planctomycetes_46_10_curated id=16386779 partial=0
scaf=RBG_13_scaffold_1401 bin=RBG_13_Planctomycetes_46_10
sample=2500-genomes proj=2500 Genomes
mSVRSFQARVECDKQTMEHLWRTHKVFNERLPEIIKILFKMKRGECGQNDKQKSLYKSISQSIL
EANAQNADYLLNSVSIKGWKPGTAKKYRNASFTWADDAAKLSSQGIHVYDKKQVLGDLPGMMSQ
MVCRQSVEAISGHIELTKKWEKEHNEWLKEKEKWESEDEHKKYLDLREKFEQFEQSIGGKITKR
RGRWHLYLKWLSDNPDFAAWRGNKAVINPLSEKAQIRINKAKPNKKNSVERDEFFKANPEMKAL
DNLHGYYERNFVRRRKTKKNPDGFDHKPTFTLPHPTIHPRWFVFNKPKTNPEGYRKLILPKKAG
DLGSLEMRLLTGEKNKGNYPDDWISVKFKADPRLSLIRPVKGRRVVRKGKEQGQTKETDSYEFF
DKHLKKWRPAKLSGVKLIFPDKTPKAAYLYFTCDIPDEPLTETAKKIQWLETGDVTKKGKKRKK
KVLPHGLVSCAVDLSMRRGTTGFATLCRYENGKIHILRSRNLWVGYKEGKGCHPYRWTEGPDLG
HIAKHKREIRILRSKRGKPVKGEESHIDLQKHIDYMGEDRFKKAARTIVNFALNTENAASKNGF
YPRADVLLLENLEGLIPDAEKERGINRALAGWNRRHLVERVIEMAKDAGFKRRVFEIPPYGTSQ
VCSKCGALGRRYSIIRENNRREIRFGYVEKLFACPNCGYCANADHNASVNLNRRFLIEDSFKSY
YDWKRLSEKKQKEEIETIESKLMDKLCAMHKISRGSISK (SEQ ID NO: 74)

FIG. 1 (Cont.)

\>CasZi.2|026|3300009652.a:Ga0123330_1010394_01528
Zr6.c2c1.inclusive
MHLWRTHCVFNQRLPALLKRLFAMRRGEVGGNEAQRQVYQRVAQFVLARDAKDSVDLLNAVSLR
KRSANSAFKKKATISCNGQAREVTGEEVFAEAVALASKGVFAYDKDDMRAGLPDSLFQPLTRDA
VACMRSHEELVATWKKEYREWRDRKSEWEAEPEHALYLNLRPKFEEGEAARGGRFRKRAERDHA
YLDWLEANPQLAAWRRKAPPAVVPIDEAGKRRIARAKAWKQASVRAEEFWKRNPELHALHKIHV
QYLREFVRPRRTRRNKRREGFKQRPTFTMPDPVRHPRWCLFNAPQTSPQGYRLLRLPQSRRTVG
SVELRLLTGPSDGAGFPDAWVNVRFKADPRLAQLRPVKVPRTVTRGKNKGAKVEADGFRYYDDQ
LLIERDAQVSGVKLLFRDIRMAPFADKPIEDRLLSATPYLVFAVEIKDEARTERAKAIRFDETS
ELTKSGKKRKTLPAGLVSVAVDLDTRGVGFLTRAVIGVPEIQQTHHGVRLLQSRYVAVGQVEAR
ASGEAEWSPGPDLAHIARHKREIRRLRQLRGKPVKGERSHVRLQAHIDRMGEDRFKKAARKIVN
EALRGSNPAAGDPYTRADVLLYESLETLLPDAERERGINRALLRWNRAKLIEHLKRMCDDAGIR
HFPVSPFGTSQVCSKCGALGRRYSLARENGRAVIRFGWVERLFACPNPECPGRRPDRPDRPFTC
NSDHNASVNLHRVFALGDQAVAAFRALAPRDSPARTLAVKRVEDTLRPQLMRVHKLADAGVDSP
F     (SEQ ID NO: 75)

*CasZj*

\>CasZj.1|130|3300012532.a:Ga0137373_10000316_00700 c2c4
MATLVYRYGVRAHGSARQQDAVVSDPAMLEQLRLGHELRNALVGVQHRYEDGKRAVWSGFASVA
AADHRVTTGETAVAELEKQARAEHSADRTAATRQGTAESLKAARAAVKQARADRKAAMAAVAEQ
AKPKIQALGDDRDAEIKDLYRRFCQDGVLLPRCGRCAGDLRSDGDCTDCGAAHEPRKLYWATYN
AIREDHQTAVKLVEAKRKAGQPARLRFRRWTGDGTLTVQLQRMHGPACRCVTCAEKLTRRARKT
DPQAPAVAADPAYPPTDPPRDPALLASGQGKWRNVLQLGTWIPPGEWSAMSRAERRRVGRSHIG
WQLGGGRQLTLPVQLHRQMPADADVAMAQLTRVRVGGRHRMSVALTAKLPDPPQVQGLPPVALH
LGWRQRPDGSLRVATWACPQPLDLPPAVADVVVSHGGRWGEVIMPARWLADAEVPPRLLGRRDK
AMEPVLEALADWLEAHTEACTARMTPALVRRWRSQGRLAGLTNRWRGQPPTGSAEILTYLEAWR
IQDKLLWERESHLRRRLAARRDDAWRRVASWLARHAGVLVVDDADIAELRRRDDPADTDPTMPA
SAAQAARARAALAAPGRLRHLATITATRDGLGVHTVASAGLTRLHRKCGHQAQPDPRYAASAVV
TCPGCGNGYDQDYNAAMLMLDRQQQP (SEQ ID NO: 76)

*CasZk*

\>CasZk.1|012|3300005602.a:Ga0070762_10001740_01506
Zr6.c9.inclusive
MSRVELHRAYKFRLYPTPAQVAELAEWERQLRRLYNLAHSQRLAAMQRHVRPKSPGVLKSECLS
CGAVAVAEIGTDGKAKKTVKHAVGCSVLECRSCGGSPDAEGRTAHTAACSFVDYYRQGREMTQL
LEEDDQLARVVCSARQETLRDLEKAWQRWHKMPGFGKPHFKKRIDSCRIYFSTPKSWAVDLGYL
SFTGVASSVGRIKIRQDRVWPGDAKFSSCHVVRDVDEWYAVFPLTFTKEIEKPKGGAVGINRGA
VHAIADSTGRVVDSPKFYARSLGVIRHRARLLDRKVPFGRAVKPSPTKYHGLPKADIDAAAARV
NASPGRLVYEARARGSIAAAEAHLAALVLPAPRQTSQLPSEGRNRERARRFLALAHQRVRRQRE
WFLHNESAHYAQSYTKIAIEDWSTKEMTSSEPRDAEEMKRVTRARNRSILDVGWYELGRQIAYK
SEATGAEFAKVDPGLRETETHVPEAIVRERDVDVSGMLRGEAGISGTCSRCGGLLRASASGHAD
AECEVCLHVEVGDVNAAVNVLKRAMFPGAAPPSKEKAKVTIGIKGRKKKRAA
     (SEQ ID NO: 77)

FIG. 1 (Cont.)

\>CasZk.2|016|3300005921.a:Ga0070766_10011912_01491
Zr6.c9.inclusive
MSRVELHRAYKFRLYPTPVQVAELSEWERQLRRLYNLGHEQRLLTLTRHLRPKSPGVLKGECLS
CDSTQVQEVGADGRPKTTVRHAEQCPTLACRSCGALRDAEGRTAHTVACAFVDYYRQGREMTEL
LAADDQLARVVCSARQEVLRDLDKAWQRWRKMPGFGKPRFKRRTDSCRIYFSTPKAWKLEGGHL
SFTGAATTVGAIKMRQDRNWPASVQFSSCHVVRDVDEWYAVFPLTFVAEVARPKGGAVGINRGA
VHAIADSTGRVVDSPRYYARALGVIRHRARLFDRKVPSGHAVKPSPTKYRGLSAIEVDRVARAT
GFTPGRVVTEALNRGGVAYAECALAAIAVLGHGPERPLTSDGRNREKARKFLALAHQRVRRQRE
WFLHNESAHYARTYSKIAIEDWSTKEMTASEPQGEETRRVTRSRNRSILDVGWYELGRQLAYKT
EATGAEFAQVDPGLKETETNVPKAIADARDVDVSGMLRGEAGISGTCSKCGGLLRAPASGHADA
ECEICLNVEVGDVNAAVNVLKRAMFPGDAPPASGEKPKVSIGIKGRQKKKAA
   (SEQ ID NO: 78)

\>CasZk.3|106|3300009698.a:Ga0116216_10000905_01565 c2c9
MEAIATGMSPERRVELGILPGSVELKRAYKFRLYPMKVQQAELSEWERQLRRLYNLAHEQRLAA
LLRYRDWDFQKGACPSCRVAVPGVHTAACDHVDYFRQAREMTQLLEVDAQLSRVICCARQEVLR
DLDKAWQRWRKKLGGRPRFKRRTDSCRIYLSTPKHWEIAGRYLRLSGLASSVGEIRIEQDRAFP
EGALLSSCSIVRDVDEWYACLPLTFTQPIERAPHRSVGLNRGVVHALADSDGRVVDSPKFFERA
LATVQKRSRDLARKVSGSRNAHKARIKLAKAHQRVRRQRAAFLHQESAYYSKGFDLVALEDMSV
RKMTATAGEAPEMGRGAQRDLNRGILDVGWYELARQIDYKRLAHGGELLRVDPGQTTPLACVTE
EQPARGISSACAVCGIPLARPASGNARMRCTACGSSQVGDVNAAENVLTRALSSAPSGPKSPKA
SIKIKGRQKRLGTPANRAGEASGGDPPVRGPVEGGTLAYVVEPVSESQSDT
   (SEQ ID NO: 79)

\>CasZk.4|072|3300006028.a:Ga0070717_10000077_00263
Zr6.c9.inclusive
MTVRTYKYRAYPTPEQAEALTSWLRFASQLYNAALEHRKNAWGRHDAHGRGFRFWDGDAAPRKK
SDPPGRWVYRGGGGAHISKNDQGKLLTEFRREHAELLPPGMPALVQHEVLARLERSMAAFFQRA
TKGQKAGYPRWRSEHRYDSLTFGLTSPSKERFDPETGESLGRGKTVGAGTYHNGDLRLTGLGEL
RILEHRRIPMGAIPKSVIVRRSGKRWFVSIAMEMPSVEPAASGRPAVGLDMGVVTWGTAFTADT
SAAAALVADLRRMATDPSDCRRLEELEREAAQLSEVLAHCRARGLDPARPRRCPKELTKLYRRS
LHRLGELDRACARIRRRLQAAHDIAEPVPDEAGSAVLIEGSNAGMRHARRVARTQRRVARRTRA
GHAHSNRRKKAVQAYARAKERERSARGDHRHKVSRALVRQFEEISVEALDIKQLTVAPEHNPDP
QPDLPAHVQRRRNRGELDAAWGAFFAALDYKAADAGGRVARKPAPHTTQECARCGTLVPKPISL
RVHRCPACGYTAPRTVNSARNVLQRPLEEPGRAGPSGANGRGVPHAVA (SEQ ID NO: 80)

FIG. 1 (Cont.)

CasZ1

>CasZ1.1|004|3300001256.a:JGI12210J13797_10004690_01983 c2c9
MNCRYRYRIYPTPGQRQSLARLFGCVRVVWNDALFLCRQSEKLPKNSELQKLCITQAKKTEARG
WLGQVSAIPLQQSVADLGVAFKNFFQSRSGKRKGKKVNPPRVKRRNNRQGARFTRGGFKVKTSK
VYLARIGDIKIKWSRPLPSEPSSVTVIKDCAGQYFLSFVVEVKPEIKPPKNPSIGIDLGLKTFA
SCSNGEKIDSPDYSRLYRKLKRCQRRLAKRQRGSKRRERMRVKVAKLNAQIRDKRKDFLHKLST
KVVNENQVIALEDLNVGGMLKNRKLSRAISQAGWYEFRSLCEGKAEKHNRDFRVISRWEPTSQV
CSECGYRWGKIDLSVRSIVCINCGVEHDRDDNASVNIEQAGLKVGVGHTHDSKRTGSACKTSNG

AVCVEPSTHREYVQLTLFDW      (SEQ ID NO: 81)

>CasZ1.2|014|3300005660.a:Ga0073904_10021651_01988 c2c9
MKSRWTFRCYPTPEQEQHLARTFGCVRFVWNWALRARTDAFRAGERIGYPATDKALTLLKQQPE
TVWLNEVSSVCLQQALRDLQVAFSNFFDKRAAHPSFKRKEARQSANYTERGFSFDHERRILKLA
KIGAIKVKWSRKAIPHPSSIRLIRTASGKYFVSLVVETQPAPMPETGESVGVDFGVARLATLSN
GERISNPKHGAKWQRRLAFYQKRLARATKGSKRRMRIKRHVARIHEKIGNSRSDTLHKLSTDLV
TRFDLICVEDLNLRGMVKNHSLARSLHDASIGSAIRMIEEKAERYGKNVVKIDRWFPSSKTCSD
CGHIVEQLPLNVREWTCPECGTTHDRDANAAANILAVGQTVSAHGGTVRRSRAKASERKSQRSA

NRQGVNRA     (SEQ ID NO: 82)

FIG. 2
PAM depletion assay results for C2c3_1
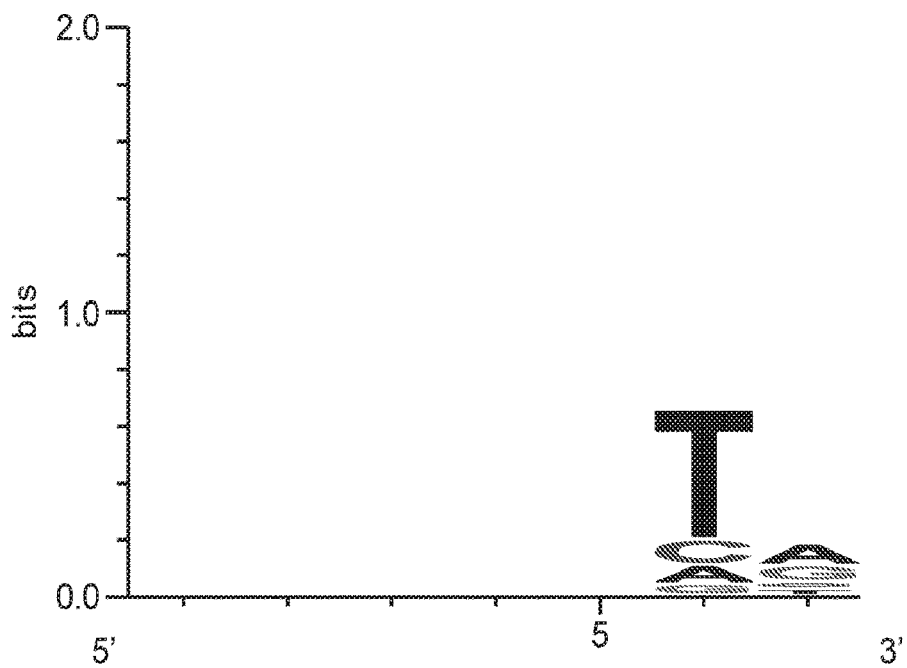
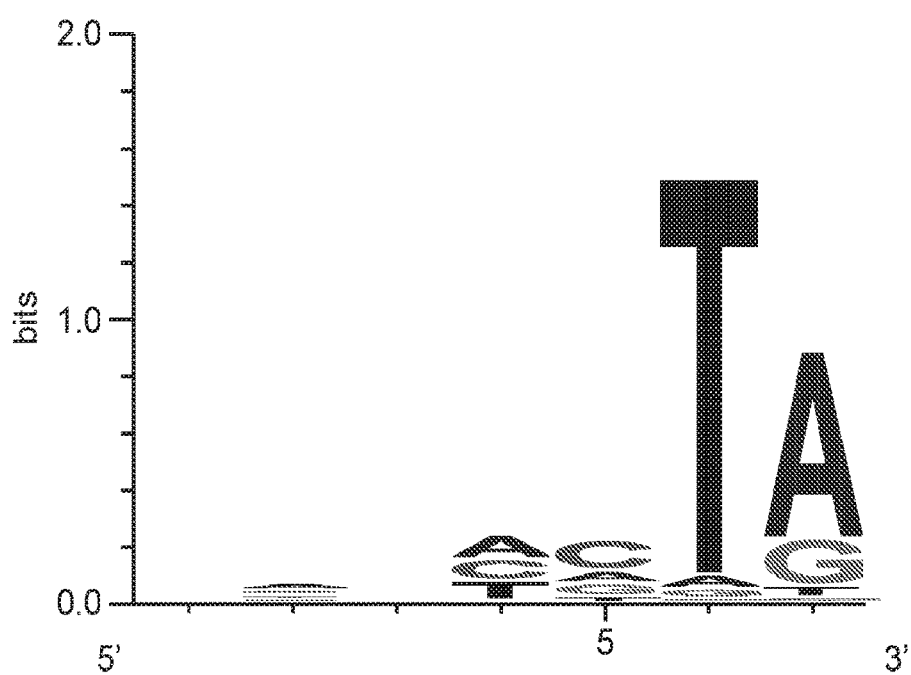

FIG. 8

|   | 1 | | | | | | | | 8 |
|---|---|---|---|---|---|---|---|---|---|
| 1. CasY1 | M | - | - | R | K | K | L | F | K | - - - - - - - - - - - - - - - - - - - - - - - - - - - - - - - - - - - - - - - - - - - - - - - - - - - - - - - - - - - - - - - - - - - - - - - - - - - - - - - G Y |
| 2. CasY2 | M Q K V R K T L S - - - - - - - - - - - - - - - - - - - - - - - - - - - - - - - - - - E V H K N P Y G T K V R N A K - - - - - - - - - - - - T G Y |
| 3. CasY3 | M K A K K S F Y N - - - - - - - - - - - - - - - - - - - - - - - - - - - - - - - - - - - - - - - - - - Q K R K F G K R - - - - - - - - - - - - - G Y |
| 4. CasY4 | M - - - S K R - - - - - - - - - - - - - - - - - - - - - - - - - - - - - - - - - - - - - - - - - - - - - - - - - H P R I S G V K - - - - - - - - - - - - - G Y |
| 5. CasY5 | M A E S K Q V Q C R K C G A S M K Y E V I G L G K K S C R Y M C P D C G N H T S A R K I Q N K K R D K K Y G S A S |
| 6. CasY6 | M A E S K Q V Q C R K C G A S M K Y E V I G L G K K S C R Y M C P D C G N H T S A R K I Q N K K R D K K Y G S A S |
| 7. CasY7 | M - - - K R I L N - - - - - - - - - - - - - - - - - - - - - - - - - - - - - - - - - - - - - - - - - - - - - - - - - - - - - - - - - - - - - - - - - - - - - - - S L |

|   | 11 | 21 | 24 | 32 | 39 | 49 |
|---|---|---|---|---|---|---|
| 1. CasY1 | I L H N K R L V Y T G - - - - K A A - - I R S I K Y P - - L I V A P - - - N K T A L N N E S E K T I Y D Y E H L F |
| 2. CasY2 | S L Q T E R L S I Y T G - - - - K E G - - M R S F K I E - - L L E N K - - N K E V F D E F V K K I R N D Y I I S Q V |
| 3. CasY3 | R I H D E R L A Y S G - - - - G I G - - S M R S I K Y E - - L K D S - Y G T A G L R N R T A D A T I S K N K W L Y |
| 4. CasY4 | R L H A Q R L E Y T G - - - - K S G - - A M R T I K Y P - - L Y S S P S G G R T V P R E I V S A I N D D Y I V G F Y |
| 5. CasY5 | K I A Q S Q R I A V A G A L Y P D K K V Q T L K T Y K Y P A D L L N G E - V H D S G V A E K T A Q A L Q E D E I G L L |
| 6. CasY6 | K I A Q S Q R I A V A G A L Y P D K K V Q T L K T Y K Y P A D L L N G E - V H D R I G V A E K T E Q A L Q E D E I G L L |
| 7. CasY7 | K V A A L R L L F R G - - - - K G S E L V K T K Y P - - L I V S P - - - V Q G A V E E L A I R H D N L H L F |

|   | 64 | 65 67 | 76 | 86 | 96 |
|---|---|---|---|---|---|
| 1. CasY1 | G P L N V A S Y A R - - - - - - - - - - N S N R - Y I S I V D E W I D S L R A G V I M Q S K S T S L I D L T S K L |
| 2. CasY2 | G L L N L S D W Y E - - - - - - - - - - H Y Q E K Q E H - Y I S L A D E W L E A G M T F A H K E T E T K N L I S K I |
| 3. CasY3 | G N I N D Y I L E W R S S K T D K Q T E D G D R E - S S T L G E W L E A T R L G F V E I S K Q S H A P N D F - - - - |
| 4. CasY4 | G L S N F D D L Y N - - - - - - - - - - A E K R N E E K V Y S V L D F W Y D C V Q Y G A V E I S Y T A P G T L K N V A E V |
| 5. CasY5 | G P S - - S E T A C W I - - - - - - A S Q K Q S E P - Y I S V V D F W F D A V C A G V F A Y S G A R L L S T V L Q L |
| 6. CasY6 | G P S - - S E T A C W I - - - - - - A S Q K Q S E P - Y I S V V D F W F D A V C A G V F A Y S G A R L L S T V L Q L |
| 7. CasY7 | G Q K E I V D L M E - - - - - - - - - - K D E G T Q V - Y I S V V D F W L D T L R L G M F E S P S A N A L K I T T G K F |

FIG. 8 (Cont.)

```
               106            113            123            133            137      144
                |              |              |              |              |        |
1. CasY1   EGSKSPSEKI---FEQIDFELKNKLDKEQFKDILLNTGI-----------------RSSSNVRSLL
2. CasY2   RGDKSIVDKFNASIKKKHADLYALVDIKALYDFL-------------TSDARRGLKTEEEF
3. CasY3   --NETALQDL--FETLDDDLKHVLDRKKWCDFLKTGTPK-------TNDQGRLKKQIKNL
4. CasY4   RGGS-------YELTKTLKGSHLYDELQTDKVIKFLNKKEISRANGSLDKL
5. CasY5   SGEE-------SVLRAALASSPFVDDINLAQAEKFL---AVSRRTGQ-DKL
6. CasY6   SGEE-------SVLRAALASSPFVDDINLAQAEKFL---AVSRRTGQ-DKL
7. CasY7   NSDQ---VSPFRKVLEQSPFFLAGRLKVEPAERILSVE-----------IRKIGKRENRVENY 154            164            174            181            191
                |              |              |              |              |
1. CasY1   RGRFLKCEKEEFRDTEEVIACVDKWSKDIIVEG----KSILVSKQFLYWEEEEGT----
2. CasY2   ----------ENSKRNTLFP--KFRKKDNKAVDLWVKKFIGLDNKDKLNFTKKFIGF---
3. CasY3   ----------LKGNKREEIE--KTLNESDDELKEKI-NRIADVFAKNKSDKYTIEKL---
4. CasY4   KKDIIDCEKAEYRERHK---DQCNKLADDIKNAKKDAGASLGEROKKLFRDEFEGH---
5. CasY5   GKRIGECFAEGRLEALGIKDRMRE--FVQAID-----VAQTAGQRFAAKLKIEGH---
6. CasY6   GKRIGECFAEGRLEALGIKDRMRE--FVQAID-----VAQTAGQRFAAKLKIEGH---
7. CasY7   AADVETCEIGQLSSDEK--QSIIQKLANDLW------DSKDHEEQRMLKADFEALPLI 197  201        209            219            230      231
                |    |          |              |              |        |
1. CasY1   ----KIFPHFKD--NHIDLPKITFFWEPSLEFSPHLPLANC-------------LER
2. CasY2   ----DPNPQIKY--DHTFFFHQDINFDLERITTPKELISTYKKFLGKNKD
3. CasY3   -D-KFNTEKYPRINDVQAFFCHPDFEEITERDRTKT-LDLIINRF---NKR
4. CasY4   SEQSENDKPSFTNPLNTCCLLIPEDTVNNRNRGE---VLFNKL---KEY
5. CasY5   SQMPEAKQ---WNNDSGLTVCTLPDYYV-PEENRADQ-LVVLLRRL--REI
6. CasY6   SQMPEAKQ---WNNDSGLTVCTLPDYYV-PEENRADQ-LVVLLRRL--REI
7. CasY7   KDPKAVTEEDPLNETAGKQKPLELCVCLVIPEELYTRGFSIAD-----FLVQRL----TLL
```

FIG. 8 (Cont.)

```
              237            244               251                  261           265                    275
              |              |                 |                    |             |                      |
1. CasY1      LKKFDISRES-----LIGLDN-NFSIAFSNYFNE----LE--NLISRGEIKKIVTAVLA
2. CasY2      LYGSDETTED-QLKMVLGFHN-NHGAFSKYFNA-----SLEAFRGDNSLVE----QIIN
3. CasY3      YEITENKKDD-KTSNRMATYSLNQGYIPRVLND-----LEFLFVKDNEDDFSIQFLSDLEN
4. CasY4      AQKLDKNEGSLEMWEYLGIGN-SGTAFSNFLGE----GFL--GRIRENKITELKKAMMD
5. CasY5      AYCMGIEDEA--GFEHLGL---DPGALSNFSNGNPKRGEL--GRILNNDIIALANNMSA
6. CasY6      AYCMGIEDEA--GFEHLGL---DPGALSNFSNGNPKRGEL--GRILNNDIIALANNMSA
7. CasY7      RDKMSTDTAE-DCLEYVGLEEEKGNGVNSLLGT-----EL--KNLQGDGFEQIFQFMLG 285                 292                 302               310               320          330
              |                   |                   |                 |                 |            |
1. CasY1      VISKSW-------ENEPELEKRLHFLSEKAKIL---GYPKLTSSWADYRVILGGKITSWHSNY
2. CasY2      NSPYW-------NSHRKELEKRIIFLQVQSKKI---KETELGKP-HELYLAISFGGKFEISWVSNY
3. CasY3      FFSFS-------NEQIKITLKERLKKIRDAALTIKL--GKPQLADKWDDYASDFGKLESWYSNR
4. CasY4      ITDAWRGQEQEELEKRIDAALTIKL--REPKFDNHWGGYRSDINGKLLSWLQNY
5. CasY5      MTPYW--EGRKGELIERLAWLKHRAEGLYLKEPHFGNSWADHRSRITFSRLAGWLSGC
6. CasY6      MTPYW--EGRKGELIERLAWLKHRAEGLYLKEPHFGNSWADHRSRITFSRLAGWLSGC
7. CasY7      SYVGW---QGKEDVLRERLDLAEKIVKRL--PKPKIFAGEWSGHRMFLHGQLKSWSSNF 340              343               353                 363              373
              |                |                 |                   |                |
1. CasY1      TEQLIKIVREDL-----KKHQIALDKLQEDLKKIVDSLREQIEAQREALLPLLDTM
2. CasY2      LRQEEMKRQLFGYEENKKGQKFIVGNKQELDKIIRGTDEYEIKAISKETIGLTQKC
3. CasY3      IEKLKKIPESV-----SDLRNLEKIRNVLKKQNNA----SKILELSQKI
4. CasY4      INQTVKIKEDL-----KGHKKIDKKAKEMINRFGESDTKE---EAVVSSLESIEKL
5. CasY5      AGKLKIAKDQI-----SGVRTDLFLLKRLLDAVPQSAP-----SPDFIASISAL
6. CasY6      AGKLKIAKDQI-----SGVRTDLFLLKRLLDAVPQSAP-----SPDFIASISAL
7. CasY7      FRLFNETRELL-----ESIKSDIQHATMLISYVEEKGGYH------PQLLSQYRKL
```

```
                   473           483              490              497           507
                    |             |                |                |             |
1.CasY1  GLKITEDDRNALETVSVRK----PPSITEEYVTKQ--------LEKDSRKVKINAFNS-----------
2.CasY2  GINFTDQIDKQITQNLLPC-FKNDKERIEETEKQ--------FETIRRKYYL--MNS-----------
3.CasY3  FIKNVENILMSSEAEDLKN--IKIEYKEDGAKKGNYVLARFYAR--FNEDGYGGW
4.CasY4  LWKAVEKIYKSAFSSLKNSFFDTFDKDEFIKR---------LQKIFSVYRR--ENT-----------
5.CasY5  FCNNMRALFMQLESQPRKA--PRDFKCELQNR---------LQKDYKQTFLN-ARS-----------
6.CasY6  FCNNMRALFMQLESQPRKA--PRDFKCELQNR---------LQKDYKQTFLN-ARS-----------
7.CasY7  MVKQWQKVNQLVESPGAL---YQFNESELRQR---------LQAMLTVYKRD-LQT-----------

512          523                          522  525       535
          |            |                             |    |         |
1.CasY1  NRFKQITEQV--------------------LRKYNNGELPKISEVFYR----YPREISHVAIR
2.CasY2  SRFHHVLEGTINNRKLIEMKKRENSELKTFSDISKFVLSKLFLKGKKYENEVYYTFY
3.CasY3  NKVKTVLENT--------------------AREAGTDFSKYGNNNRAGRFYLN--GRERQVFTL
4.CasY4  DKNKPTVKNS--------------------FAPVCDIVSLAENEVLYK-----PKQSRSRKS
5.CasY5  NKCRALLESV--------------------LISWGEFYTYGANEKKER-----LRHEASERS
6.CasY6  NKCRALLESV--------------------LISWGEFYTYGANEKKER-----LRHEASERS
7.CasY7  EKFIKLLADV--------------------CRPLVDFFGLGGNDIIEKSCQDPRKQWQTVI 550      551                561              571        577        587
          |        |                   |                |          |          |
1.CasY1  I--------LPVKISNPRKDTSYLLDKYQISPDW---------KNSNPGEVVDLIEIYKL
2.CasY2  INPKARDQRRIKIVLDINGNNSVGITQDLVQKLKPKWDDIIFKNDMGELIDATEEKV
3.CasY3  IKF---EK-SITVEKITETVKLPSLLDEAYRDLVNENKNHKLRDVIQLSKT
4.CasY4  AAI---DKNRVRLPSTENIAKAGTATAREISVAGRDWKDLLKEEHEEYIDLIELHKT
5.CasY5  SDP---YVVQQAHEHARRLFEGFEW---------RDCSAGERVDLVEIHKK
6.CasY6  SDP---YVVQQAHEHARRLFEGFEW---------RDCSAGERVDLVEIHKK
7.CasY7  P-----LSVPADVYTACEGTAT-RLRETLGFEW---------ENLKGHEREDFLRLHQL
```

FIG. 8 (Cont.)

```
              597            607            615            625            630            640
              |              |              |              |              |              |
1. CasY1      TIGWLLSCNKDFSMDFSSY--DLKLPPEAASLIKNF-----GSCISGYYISKMIFNCI
2. CasY2      RTGILIALYCEHKFKTKKELLSLDLEASAYQYLELE----DDPEELSGTNLGRFLQSLV
3. CasY3      IMALVLSHS-DKEKQLGG-------------------------------NYI
4. CasY4      ALALLAVT-ETQLDTSAL---DFVENGTVKDFMKTR---DGNLVIEGRFLEMFSQSIV
5. CasY5      ATSFLLAIT-QAEVSVGSY---------NWLGNSTVSRYLSVA---GTDTHYGIQFEFLNATV
6. CasY6      ATSFLLAIT-QAEVSVGSY---------NWLGNSTVSRYLSVA---GTDTLYGIQLEEFLNATV
7. CasY7      LGNLLFWIR-DAKLVVKLE--DWMNNPCVQEYVEARKAIDLPLETFGFFEVPIFFLNGYL 650            660                           678
              |              |                             |
1. CasY1      TSEIKGMITLYIRIDKFVVRLYVTQMIGSNQKFPLLC--
2. CasY2      CSEIKGAINKTSRITEYLIERLTVIOPMNTEKNYPLLI--
3. CasY3      HSKLSGYNALISKRDFLSRYSVQTTINGTQCKLAIG----
4. CasY4      FSELRGLAGLMSRKEFITRSAIOTMNGKQAELLYIPHEFQS---------AKIT
5. CasY5      LSQMRGLAIRLSIQELKDGEDVQLESSCQDNLQHLLVYRASRDLAA------CKRAT
6. CasY6      LSQMRGLAIRLSIQELKDGEDVQLESSCQDNLQHLLVYRASRDLAA------CKRAT
7. CasY7      FSELRQLELLIRRKISVMTSVKTTGSPNRLFQIVLPLNPSDPEKKNSNNFQERLD 679                  687            697
                                       |                    |              |
1. CasY1      -----------------------------------LVGEKQTK-NFSRNWGVLIEEKG---DL
2. CasY2      ------------------------------NKEGKATW---------------HTAAKD---DL
3. CasY3      ------------------------------KGKSKKGN-EIDRYEYAFQFFKN---DD
4. CasY4      TPKEMSRAFLDLAPAEFATSLEPESLSEKSLLKQMR-YPHYFGYELTRTGQGIDG
5. CasY5      CPAELDPKILVPVGAFIASVMKMIERGDEPLAGAYLR-HRPHSFGWQHRVRGVA-EV
6. CasY6      CPAELDPKILVPAGAFIASVMKMIERGDEPLAGAYLR-HRPHSEGWQLRVRGVA-EV
7. CasY7      TPTGLSRRFIDLTLDAFAGKL---LTDPVTQELKTMAGFYDHLEGFKLPCKLAAMSN
```

FIG. 8 (Cont.)

```
                704                    711                    721                    729                    737                    747
                 |                      |                      |                      |                      |                      |
1. CasY1   GEEK-----NQEKCLIFKDKTDFAK--AKEVEIFKNN---WRHRTSKYQIQFINRLFKKT
2. CasY2   SKKK-GG-GTVAMNQKIGKNFFGKQDYKTVFMLQDKR--EDLTSKYHLQFLSKTLDTG
3. CasY3   SKIN--------LKVIKNNSHK---NIDFNDNENKTNALQVYSSNYIQFLDWFFEKH
4. CasY4   GVAENALRLEKSPVKKREIKCKQ--YKTLGRGQNKT--VLYVRSYYQTQFLEWFLHRP
5. CasY5   GMDQ-----GTALAFQKPTESEPFK--IKPFSAQYGPV--LWLNSSYSQSQYLDGFLSQP
6. CasY6   GMDQ-----GTALAFQKPTESEPFK--IKPFSAQYGPV--LWLNSSYSQSQYLDGFLSQP
7. CasY7   HPGSSSKMVVLAKPKKGVASNIG--FEPIPDPAHPV--FRVRSSWPELKYIEGLLYLP 754                    762                    772                    782                    789                    799
                 |                      |                      |                      |                      |                      |
1. CasY1   ----KEWDLMN-LVLSEPSLVLEEEWGVSMDKDKLLPLLK----KEKSCEERLYYSLP
2. CasY2   GGSWW-KNKN--IDNLSSYISFIFEQKVKVEWDLTNLDHPTKIKPSENSDDRRLFVISIP
3. CasY3   ----QGKK-TSLEVGGSFTIAEKSLLTDWSGSNPRVGFK---RSDTEEKRVEVISQP
4. CasY4   ----KNVQ-TDVAVSGSFLIDEKKKVKTRWNYDALTVALE---PVSGSERVFVISQP
5. CasY5   ----KNWS--MRVLPQAGSVRVEQRVALIWNLQAGKMRLE---RSGARAFFMPVP
6. CasY6   ----KNWS--MRVLPQAGSVRVEQRVALIWNLQAGKMRLE---RSGARAFFMPVP
7. CasY7   ----EDTP--LTELAETSVSCQSVSSVAEDLKNLTTIIG----RVGEFRVTADQP 809                    818                    827                    836                    842                    851
                 |                      |                      |                      |                      |                      |
1. CasY1   LNLVPATDYKEQSAE--IEQRNTYLGLDVIGE--FGVAYAVVRI---VRDRIELLSWG
2. CasY2   FVIKPK---QTKRKD--LQTRVNYMGIDIGE--YGLAWTIINIDL-KNKKINKISKQG
3. CasY3   ETLIPDDEDKERRKERMLKTKNRFIGIDIGE--YGLAWSLIEVDNGDKNNRGIRQLESG
4. CasY4   ETIFPE---KSAEEE--GQRYLGIDIGE---YGIAYTALE----TGDSAKILDQN
5. CasY5   ESFRPS---GSGDEA--VLAPNRYLGLFPHS-GGIEYAVVDVL---DSAGFKILERG
6. CasY6   ESFRPS---GSGDEA--VLAPNRYLGLFPHS-GGIEYAVVDVL---DSAGFKILERG
7. CasY7   EKLTPI---IPEKEE--SFIGKTYLGLDAGERSGVGFAIVTV---DGDGYEVQRLG
```

FIG. 8 (Cont.)

```
                861              870              876              886              896
                 |                |                |                |                |
1. CasY1   FIKDPALRKIRE-RVQDMK-------------------KKQVMAVESSSTAVARVREMAIHSLRNQIHSIAL
2. CasY2   FTYEPLTHKVRD-YVATIK-------------DNQVRGTFGMPDTKLARLREINAITSLRNQVHDIAM
3. CasY3   FLTDNQQVLKK-NVKSWR--------------QNQIRQTFTSPDTKIARLRESLIGSYKNQLESLIV
4. CasY4   FISDPQLKTIRE-EVKGLK--------------LDQRRGTFAMPSTKIARIRESLVHSLRNIHHLAL
5. CasY5   TTAVNGFSQKRG-ERQEEAH-----------REKQRRGISDIGRKKPVQAEVDAANELHRKYTDVAT
6. CasY6   TLAVNGFSQKRG-ERQEEAH-----------REKQRRGISDIGRKKPVQAEVDAANELHRKYTDVAT
7. CasY7   VHEDTQLMAIQQVASKSLKEPVFQPLRKGTF----RQQERIRKSLRGCYWNFYHALVI 906              916              926              936              947
                 |                |                |                |                |
1. CasY1   AYKAKITLYEISTISNFETGGNRMAKIYRSIKVSIDVYR----------------ESGADTLVSEMI
2. CasY2   RIYDAKPVYEFEISNFETGSNKVKVIYDSIVKRAIDIGRGQ-------NNTEADNTEVNLV
3. CasY3   AKKANLSFEYEMSGFEVGGKRVAKIYDSIKRGSVRK----------------KDNNSQNDQS
4. CasY4   KHKAKIVYELEWSRFEEGKQKIKKVYATLKRAIDVYS------------EIDADKNLQTTV
5. CasY5   RLGCRIVVQWAPQPKPGTAPTAQTVYARAVRTEAPRIS--------GNQEDHARMKSS
6. CasY6   RLGCRIVVQWAPQPKPGTAPTAQTVYARAVRTEAPRIS--------GNQEDHARMKSS
7. CasY7   KYRAKVVHESVGSSGLVGQWLRAFQKDLKLADVLPKKGGKNGVDKKKRESSAQDTL 956              967              977              986              996
                 |                |                |                |                |
1. CasY1   ---KKNKQMGNHISSYATSYTCNCAR-TPFELVIDNDKEYEKG-----G
2. CasY2   WG-------KTSKQFGSQIGAYATSYICSFCGY-SPYYEFENSKSGDEEG-----A
3. CasY3   WG-------KKGINEWSFETTAGTHSQFCTHCKR-WSSLAIVDIEEYELKD-----
4. CasY4   WG----------KLAVASEISASYTSQFCGACKKLWRAEMQVDETITT-----Y
5. CasY5   WGYTWGTYWEKRKPEDILGISTQVYWGGIGESCP------------
6. CasY6   WGYTWSTYWEKRKPEDILGISTQVYWGGIGESCP------------
7. CasY7   WG---GAFS-KKEEQTAFEVQACSSQFCLKCGW-WFQLGMREVNRVQESGVVLDW
```

FIG. 8 (Cont.)

```
              1,002              1,009              1,019              1,028                    1,042
               |                  |                  |                  |                        |
1. CasY1   DEFIFNVGDIIIEKKVRGFLQKSLL-GKTIKGKEVLKSIKEYARPPIREV-----
2. CasY2   RDNLYQMK--------------KLSRPSLE--DELQGNPVYKTERDFDKYKNDQR---
3. CasY3   NDNLFKVKIN---DGEVRLLGKKGWRSGEKIKGKELFGPVKDAMRPNVDGL-GMKIVKR
4. CasY4   MELIGTVR-----------------------VIKGGTLIDAIKDFMRPPIFDENDTPFKY
5. CasY5   ---------------------------------------------------------
6. CasY6   ---------------------------------------------------------
7. CasY7   NRSIVTFLIESSGEKVYGFSPQQLEKGFRPDIETFKKMVRDFMRPPMFDRKGRPAAAY 1,043 1,046                     1,055         1,062           1,070         1,080
             |    |                         |             |               |             |
1. CasY1   ----LLEGEDVEQLLK-----RRGNSYIYRCPF---CGYKTDADIQAALNIACRGYIISD
2. CasY2   -----LQKTGDKDGEWKT----HRGNTATYACQK----CRHISDADIQAISYWIALKQVVRD
3. CasY3   KYL-----KLDLRDWVS-----RYGNMAIFICPYVD-CHHISHADKQAAFNIAV
4. CasY4   RDF-----CDKHHISKK-----MRGNSCLFICPF----CRANADADIQAISQTIALLIRYVKE
5. CasY5   ---------------------------------------AVAVALLGHIRA
6. CasY6   ---------------------------------------AVAVALLGHIRA
7. CasY7   ERFVLGRRHRRYRFDKVFEERFGRSALFICPRVGCGNFDHISEQSAVLALIGVIAD 1,090              1,100              1,110          1,114   1,122 1,125
             |                  |                  |             |       |    |
1. CasY1   NAKDAVKEGERKLDYILEVRKLWE--------------KNGAVLRSAKFL
2. CasY2   FYKDKEMDGDLIQGDNKDKRKVNELNRLIGVHKDVPIINKNLITSLDINLL
3. CasY3   -------------------------------------
4. CasY4   EKKVE------DYFERERKL------------------KNIKVLGQVEKI
5. CasY5   TSTQTEWE-----------------------------REEVFGRLKFFPIS
6. CasY6   TSTQTEWE-----------------------------REEVFGRLKFFPIS
7. CasY7   KEGMSGKK----LVYVRLAELMAE-------------WKLKKLERSVEEQS-SAQ
```

FIG. 8 (Cont.)

|   | 818 | 827 | 836 | 844 | 850 |
|---|---|---|---|---|---|
| 1. CasY1 | HEQRNTYLGDVGEF | -GVAYAVRI | --VRDR--- | -IELLS-WGFLKDPA |
| 2. CasY2 | LQTRVNYMGIDIGEY | -GLAWTIIN | DLKNKK--- | INKISKQGFIYEPL |
| 3. CasY3 | LKTKNRFLGIDIGEY | -GLAWSLIEVD | -NGDKNNRGIROLIE | -SGFHTDNQ |
| 4. CasY4 | GQRYLGIDIGEY | -GIAYTALEH | --TGDS--- | -AKILD-QNFTSDPQ |
| 5. CasY5 | VLAPNRYLGLFPHSG | -GIEYAVDDV | --LDSA--- | -GFKILE-RGTHAVNG |
| 6. CasY6 | VLAPNRYLGLFPHSG | -GIEYAVDD- | --LDSA--- | -GFKILE-RGTHAVNG |
| 7. CasY7 | GKTYLGIDAGERSG | -VGFAIIVT- | --DGDG--- | -YEVQR-LGVHEDTQ |
| 8. AsCpf1_5843 | EHPETPIDRGER | -NLIYITV- | -DSTGKI-- | -LEQRS--- |
| 9. LbCpf1_SID6 | HDDNPYVLGIDRGER | -NLYIVV- | -VDGKGNI- | -VEQYSLNEIINNFN |

|   | 859 | 868 | 874 | 884 | 889 |
|---|---|---|---|---|---|
| 1. CasY1 | LRKIRE-RVQDMK | ---KKQVMAVFSSSST | ---AVARVREMAIHSLR |
| 2. CasY2 | THKVRD-YVATIK | ---DNQVRGTFGMPDT | ---KIARLRENAITSLR |
| 3. CasY3 | QQVLKK-NVKSWR | ---QNQIRQTFTSPDT | ---KIARLRESLIGSYK |
| 4. CasY4 | LKTLRE-EVKGLK | ---LDQRRGTFAMPST | ---KIARIRESLVHSLR |
| 5. CasY5 | FSQKRG-ERQEEAH | ---REKQRRGISDIGRK | ---KPVQAEVDAANELH |
| 6. CasY6 | FSQKRG-ERQEEAH | ---REKQRRGISDIGRK | ---KPVQAEVDAANELH |
| 7. CasY7 | LMALQ-QVASKSLKEPVFQPLRKGTFR | ---QERIRKSLRGCYW |
| 8. AsCpf1_5843 | LNTIQ-QFDYQKKL | ---DNREKERVAARQAWSVVGTIKDLKQGYLSQMI |
| 9. LbCpf1_SID6 | GIRIKT-DYHSLL | ---DKKEKERFEARQNWTSIENIKELKAGYLSQVV |

FIG. 8 (Cont.)

| | | 899 | 909 | 919 | 928 | 937 |
|---|---|---|---|---|---|---|
| 1. CasY1 | | NQIHS | IALAY | KAKIIY | EISISNFETGGNRM | --AKIYRSIKVSDVYR--- |
| 2. CasY2 | | NQVHD | IAMRY | DAKPVY | EFEISNFETGSNKV | --KVIYDSVKRADIGRG |
| 3. CasY3 | | NQLES | LMVIA | KKANLS | FEYEVSGFEVGGKRV | --AKIYDSIKRGSVRK--- |
| 4. CasY4 | | NRIH | ALKHKA | KIIVY | ELEVSRFEEGKQKI | --KKVYATLKKADVYS--- |
| 5. CasY5 | | RKYTD | VATRLG | CIRIIV | QWAPQPKPGTAPTA | --QTVYARAVRTEAPR--- |
| 6. CasY6 | | RKYTD | VATRLG | CIRIIV | QWAPQPKPGTAPTA | --QTVYARAVRTEAPR--- |
| 7. CasY7 | | NFYHA | LMTKY | RAKVV | HEESVGSSGLVGQWL | --RAFQKDLKKADVLPKGG |
| 8. AsCpf1_5843 | | HETIVD | LMTHY | QAVVVL | ENLNFGFKSKRTGIIA | EKAVYQQFEKMLIDK--- |
| 9. LbCpf1_SID6 | | HKTICE | LVEEKY | DAVTAL | EDLNSGFKNSRVKV | -EKQVYQKFEEKMLIDK--- |

| | | 942 | 955 | 956 960 | | |
|---|---|---|---|---|---|---|
| 1. CasY1 | | ----- | ESGADTLVSEMIWG | Y | | |
| 2. CasY2 | | ----- | QNNTEADNTEVNLVWG | KTS-KQFGSQHGAY | | |
| 3. CasY3 | | ----- | KDNNSQNDQSWG | KKGINEWSFETTAA | | |
| 4. CasY4 | | ----- | EIDADKNLQTTVWG | KLA--VASEISAS | | |
| 5. CasY5 | | ----- | SGNQEDHARMKSSWG | -YTWG------ | TYWEKRKPEDILGISTQVY | |
| 6. CasY6 | | ----- | SGNQEDHARMKSSWG | -YTWS------ | TYWEKRKPEDILGISTQVY | |
| 7. CasY7 | | ----- | KNGVDKKKRESSAQDTLWG | --GAFSKKEE-QQIAFEVQAA | | |
| 8. AsCpf1_5843 | | ----- | LNCLVLKDYPAEKVG | GVLNPYQLTDQFTSFAKMGTQSGLFYVPAP | | |
| 9. LbCpf1_SID6 | | ----- | LNYMVDKKSNPCATG | GALKGYQITNKFESFKSMSTQNGFIFYIPAW | | |

FIG. 8 (Cont.)

```
                970         980         994         995
                 |           |           |           |
1. CasY1       ATSYTCCNCARTPFELVIDNDKEYEK----------------GGDEFIFN
2. CasY2       ATSYICSFCGYSPYYEFENSKSGDEE----------------GARDNLYQ
3. CasY3       GTHSQFCTHCKRWSSLAIVDIEEYELK----------------DYNDNLFK
4. CasY4       YTSQFCGACKKLWRAEMQVDETITTQ----------------------
5. CasY5       WTGGIGESCPAVAVALIGHIRATSTQ----------------ELIGT---
6. CasY6       WTGGIGESCPAVAVALIGHIRATSTQ----------------------
7. CasY7       GSSQFCLKCGWWFQLGMREVNRVQESGVVL------------DWNRSIVT
8. AsCpf1_5843 YISKIDPLTGFVDPFFVWKTIKNHESRKHFLEGFDFLHY--DVKTGDFILH
9. LbCpf1_SID6 LISKIDPSTGFVNLLLKTKYTSIADSKK-FISSEDRIMYVPEEDLFEFALD 1,004      1,005       1,012       1,016
                  |          |           |           |
1. CasY1       VG----------DEKKVRGF-----LQKSLLGKTIKG
2. CasY2       MKK-------------------LSRPSLEDFLQG
3. CasY3       VKI--------NDGEVRLLGK--KGWRSGEKIKG
4. CasY4       VRV-----------------------IMG
5. CasY5       ----------------------TEWEKE
6. CasY6       ----------------------TEWEKE
7. CasY7       FLIE-------SSGEKVGFSP---QQLEKGFRPDI
8. AsCpf1_5843 FKMNRNLSFQRGLPGFMPAWDIVEFKNETQFDAKGTPFIAGKRIVPVIEN
9. LbCpf1_SID6 YK-----NFSRTDADYIKKWKLYSYGNRIRIFAA----AKKNNVFAWEE
```

FIG. 8 (Cont.)

|   | 1,026 | 1,036 | 1,042 | 1,043 | 1,052 |
|---|---|---|---|---|---|
| 1. CasY1 | KEVLKSIKEYARPI | --- | REV-- | --LLEGEDVEQL- | --- |
| 2. CasY2 | NPVYKTFRDFDKYKN | --- | --DQR-- | --LQKTGDKDGEWK- | --- |
| 3. CasY3 | KELFGPVKDAMRPNV | --- | --DGLGMKIVRKYLK- | --- | --- |
| 4. CasY4 | GTHIDAIKDFMRPPI | --- | FDENDTPFPKYRDFC | --- | --- |
| 5. CasY5 | EVVFGRLKKFF-PS | --- | --- | --- | --- |
| 6. CasY6 | EVVFGRLKKEF-PS | --- | --- | --- | --- |
| 7. CasY7 | ETFKKMVRDFMRPPM | --- | FDRKGRPAAAYERFV- | -LGRRHRRYRFDKV | --- |
| 8. AsCpf1_5843 | HRFTGRYRDLY-PANELIALLEEKGIVFRDGSNILPKLLENDDSHAIDTM |  |  |  |  |
| 9. LbCpf1_SID6 | VCLTSAYKELF--- | --- | NKYGINYQQG-DIRALCEQSDKAFYSSF |  |  |

|   | 1,053 | 1,061 | 1,067 |
|---|---|---|---|
| 1. CasY1 | --- | LKRRGNSYIYRCPF | --CGYKT |
| 2. CasY2 | --- | --THRGNTATYACQK | --CRHIS |
| 3. CasY3 | --- | -LDLRDWVSRYGNMAIFICPYV-- | -DCHHIS |
| 4. CasY4 | --- | --KMRGNSCLFICPF--- | --CRANA- |
| 5. CasY5 | --- | --- | --- |
| 6. CasY6 | --- | --- | --- |
| 7. CasY7 | FE--- | -ERFGRSALFICPRV--- | -GCGNFD |
| 8. AsCpf1_5843 | VALIRSVLQMRNS-NAATGEDYINSPVRDLNGVCFDSRFQNPE---WPM |  |  |
| 9. LbCpf1_SID6 | MALMSLMLQMRNSITGRTDVDFLISPVKNSDGIFYDSRNYEAQENAILPK |  |  |

FIG. 8 (Cont.)

|  | 1,072 | 1,083 | 1,093 | 1,103 | 1,113 |
|---|---|---|---|---|---|
| 1. CasY1 | DADIQAALNIACRGYTSDNAKDAVKEGERKLDYILEVRKLWEKNGAV--- | | | | |
| 2. CasY2 | DADIQAISYWIALKIQVVRDFYKDKEMDGDLIQGDNKDKRKVNELNRLIGVH | | | | |
| 3. CasY3 | HADKQAAFNIAV--------------------------------------- | | | | |
| 4. CasY4 | DADIQAISQTIALLRYVKEEKK-----------VEDYFERFRK-------- | | | | |
| 5. CasY5 | | | | | |
| 6. CasY6 | | | | | |
| 7. CasY7 | HSSEQSAVVLALIGYTADKEG---MSGK-KLVYVRLAELMAEWKLKK---- | | | | |
| 8. AsCpf1_5843 | DADANGAYHIALKIQI-----------------LLNHLKESKDLKLQN--- | | | | |
| 9. LbCpf1_SID6 | NADANGAYNIARKVLW-----------------AIGQFKAEDEKLDKVKI- | | | | |

|  | 1,119 | 1,125 |
|---|---|---|
| 1. CasY1 | ----LRSAKFE------------------- | |
| 2. CasY2 | KDVPIINKNLITSLDINLL | |
| 3. CasY3 | | |
| 4. CasY4 | ----LKNIKVLG--QMKKI | |
| 5. CasY5 | | |
| 6. CasY6 | | |
| 7. CasY7 | ----LERSRVEE--QSSAQ | |
| 8. AsCpf1_5843 | ----GSNQDWTAYIQELRN | |
| 9. LbCpf1_SID6 | ----AISNKEWTEYAQTSVK | |

| | Repeat |
|---|---|
| CasY1 | CTCCGAAAGTATCGGGGATAAAGGC (SEQ ID NO:31) |
| CasY2 | CACCGAAATTTGGAGAGGATAAGGC (SEQ ID NO:32) |
| CasY3 | CTCCGAATTATCGGGAGGATAAGGC (SEQ ID NO:33) |
| CasY4 | CCCCGAATATAGGGGACAAAAGGC (SEQ ID NO:34) |
| CasY5 (and Y6) | GTCTAGACATACAGGTGGAAAGGTGAGAGTAAAGAC (SEQ ID NO:35) |

B

```
                    PAM
5' GACATGATCGCTAATCAATACCAAACTCTGGACCGAATTC (SEQ ID NO:9)
   ||||||||||||||||||||||||||||||||||||||||
3' CTGTACTAGCGATTAGTTATGTTTGAGACCTGGCTTAAG (SEQ ID NO:10)
```

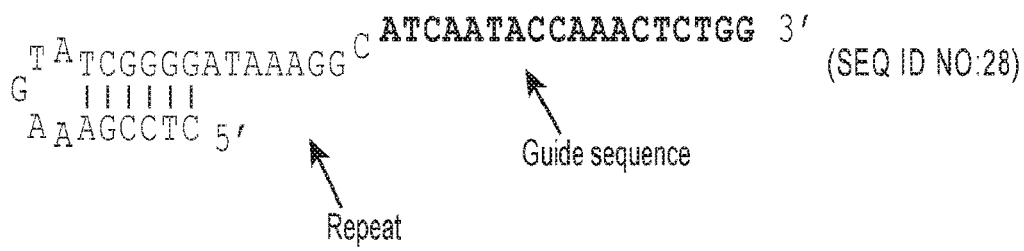

(SEQ ID NO:28)

Repeat / Guide sequence

C trancRNAs

CasY1 (76 nt)
CUCCGAAAGUAUCAAAAUAAAAAGGGUUUCCAGUUUUUAACUAAA
CUUUAGCCUUCCACCCUUUCCUGAUUUUGUU (SEQ ID NO: 41)

CasY2 (79 nt)
ACCUGCCAAAAUUUCGUUCAACGAAACUUAAGCAGGCAAGAAAAU
UUAAAAUUAAAUCCGCUGGUGGGCGGAUAAAGUC
(SEQ ID NO: 42)

CasY4 (51 nt)
GGUAUUUCCGGACAGCGGCUUGACCGCAUCGUCCUCGCCUUUU
CCUAAAAU (SEQ ID NO: 43)

FIG. 13 (Cont.)
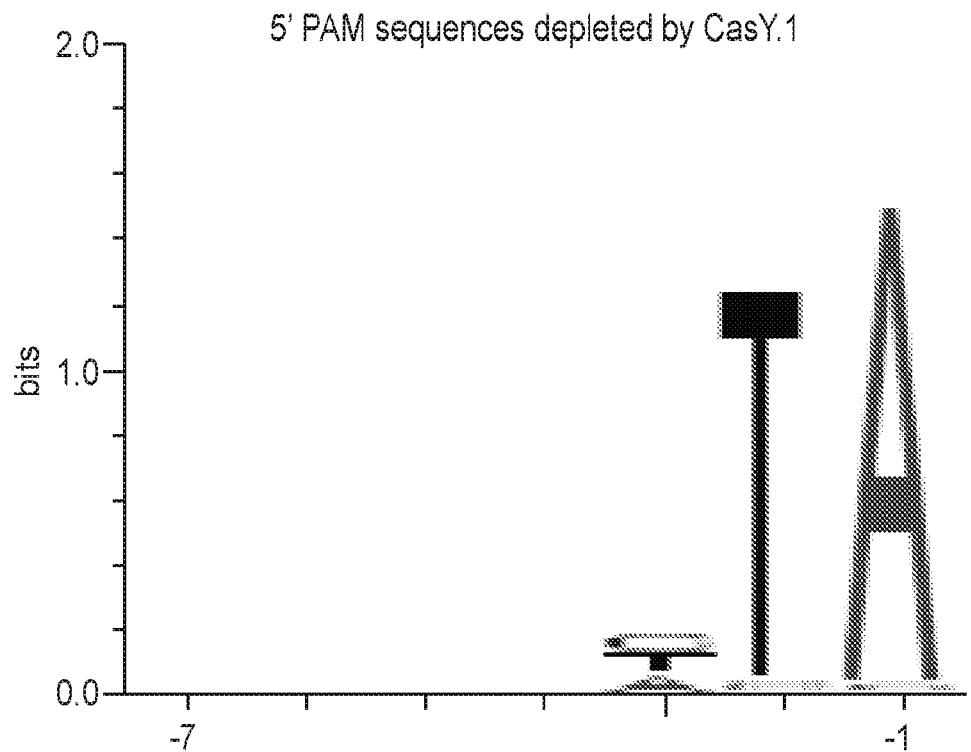
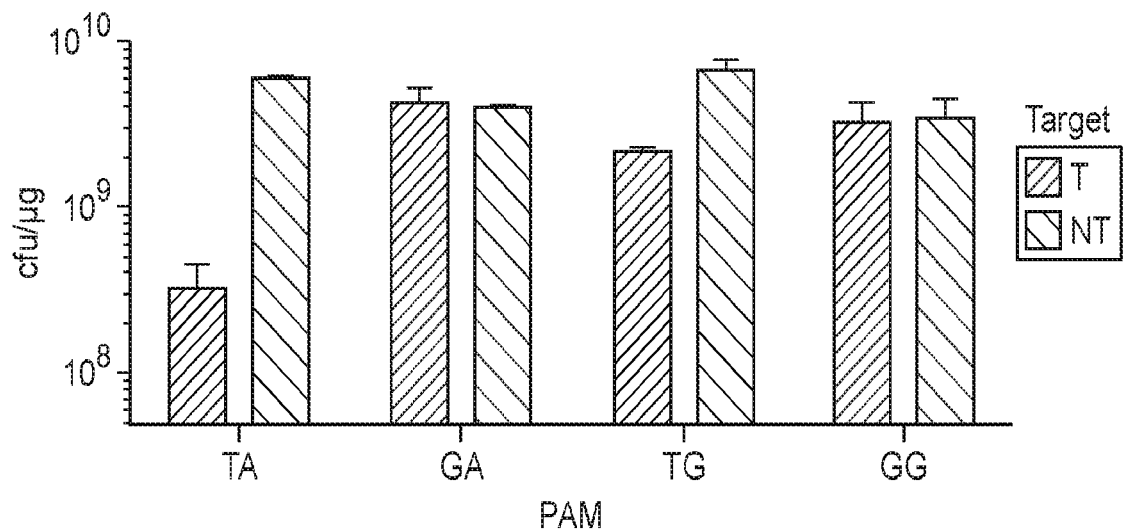

FIG. 15
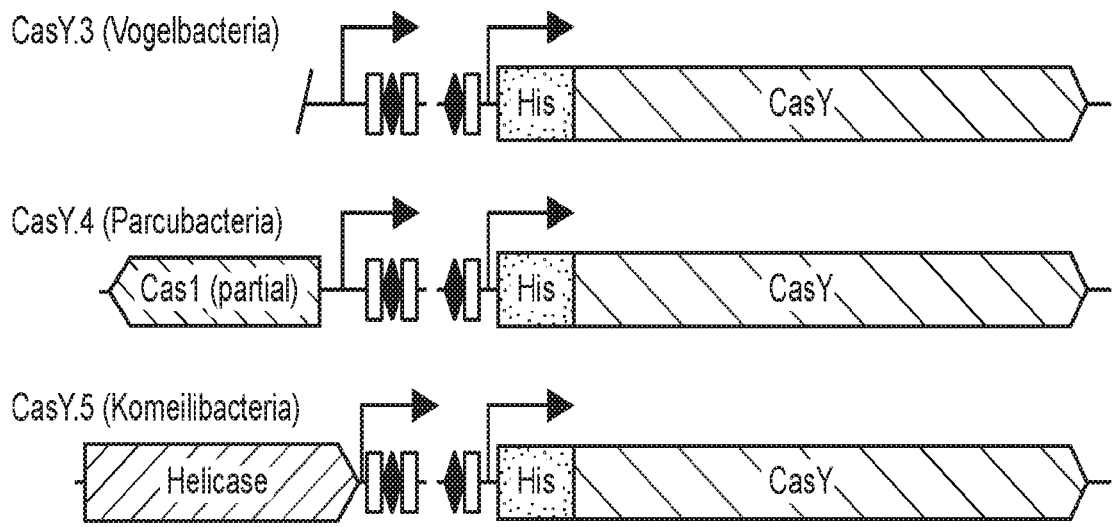
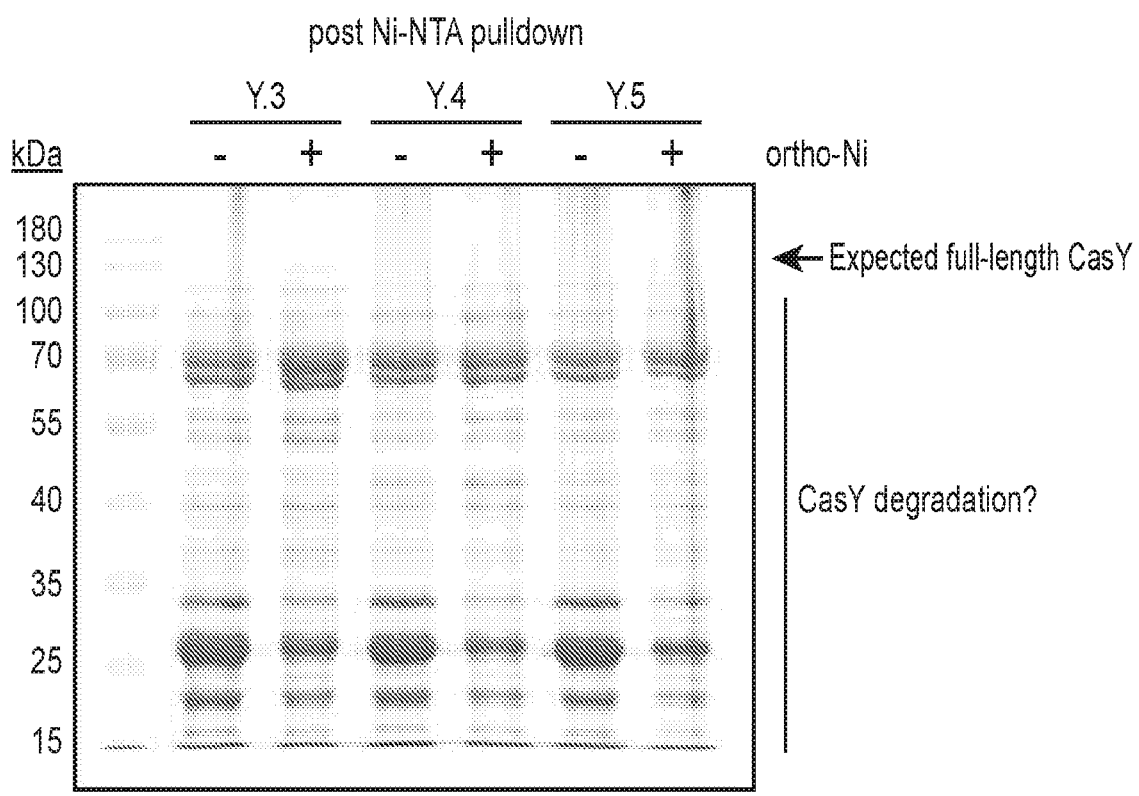

FIG. 16
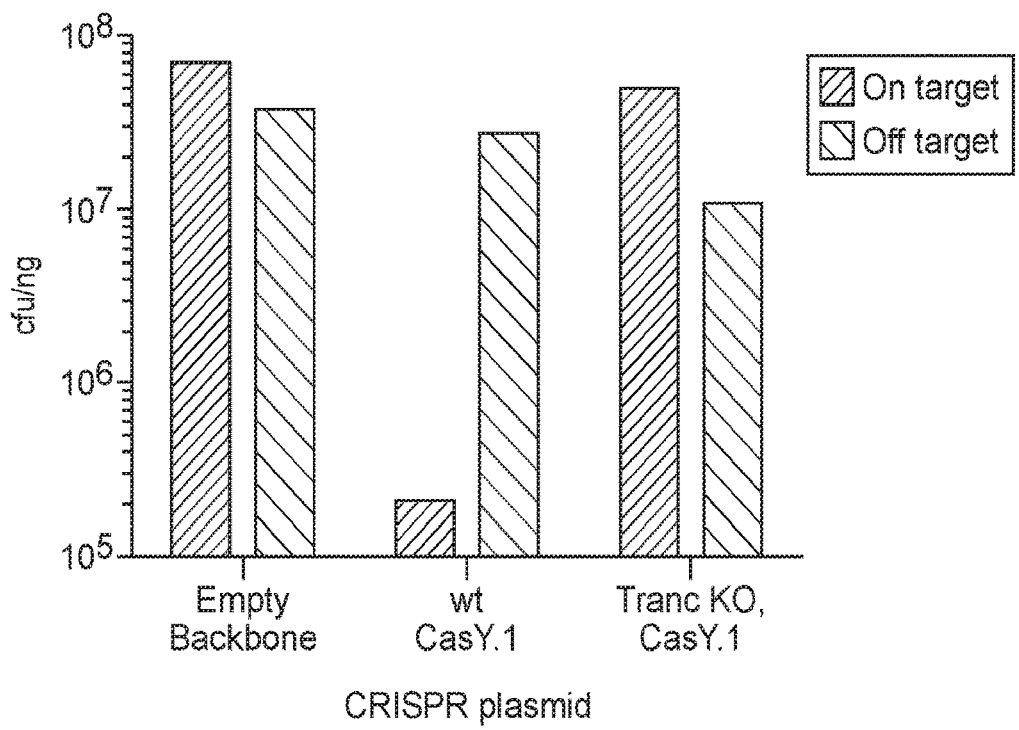
FIG. 17
CasY. 1, 2 (Katanobacteria, Parcubacteria)
CasY.3 (Parcubacteria)
CasY.4 (Parcubacteria)
CasY.5 (Novel phyla)
CasY.6 (Kerfeldbacteria)
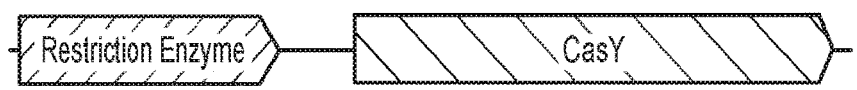

FIG. 17 (Cont.)
CasY9    Ga0123519_100271374, Hot spring (Yellowstone), needs reassembly
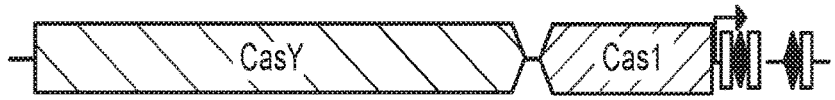
CasY10    IMNBL3_1000107226, Passalidae beetle gut (Costa Rica)
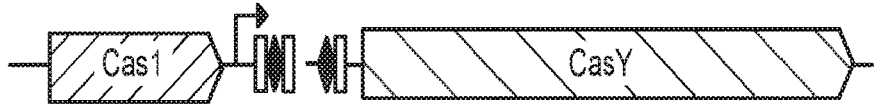
CasY11    JG124185J35167_10049851, Microbial mat (thermal spring, Yellowstone)
Cas12    Ga0123519_100033445, Hot spring (Yellowstone)
CasY13    Ga0129301_10043102, Hot spring microbial mat (California)
CasY14    Ga0172370_1000433716, lake (Antarctica)
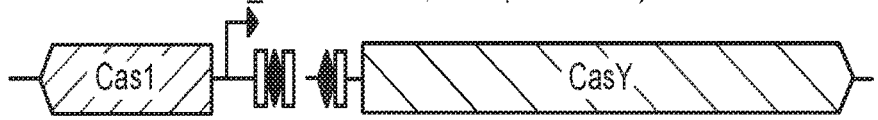
CasY15    Ga0123354_100253643, Termite gut (French Guiana), jumbo array
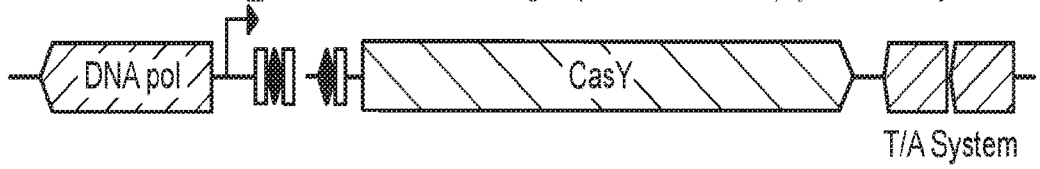
CasY16    Ga0136596_10074782 Aquatic Lake (Antarctica)

FIG. 18

| | # | Cas1 | Organism | Locus example |
|---|---|---|---|---|
| Za | 5 | I-B | DPANN | Cas1–2–4–CasZa (508aa) |
| Zb | 7 | I-B | DPANN | Cas1–2–4–CasZb (538aa) |
| Zc | 5 | I-B | DPANN | CasZc (614aa) — Cas1–2–4 |
| Zd | 1 | I-B | DPANN | Cas1–2–4–CasZd (518aa) |
| Ze | 4 | III-D* | CPR | CasZe (650aa) – Cas1 |
| Zf | 3 | III-D | CPR | CasZf (415aa) – Cas1 |
| Zg | 1 | I-E | Phage? | CasZg (712aa) – Cas1–2 |
| Zh | 1 | II-C | MGE | CasZh (401aa) – Trnsp – Cas1–2 |
| Zi | 1 | I-U | Plancto | Cas4+1–2–CasZi (744aa) |

FIG. 25
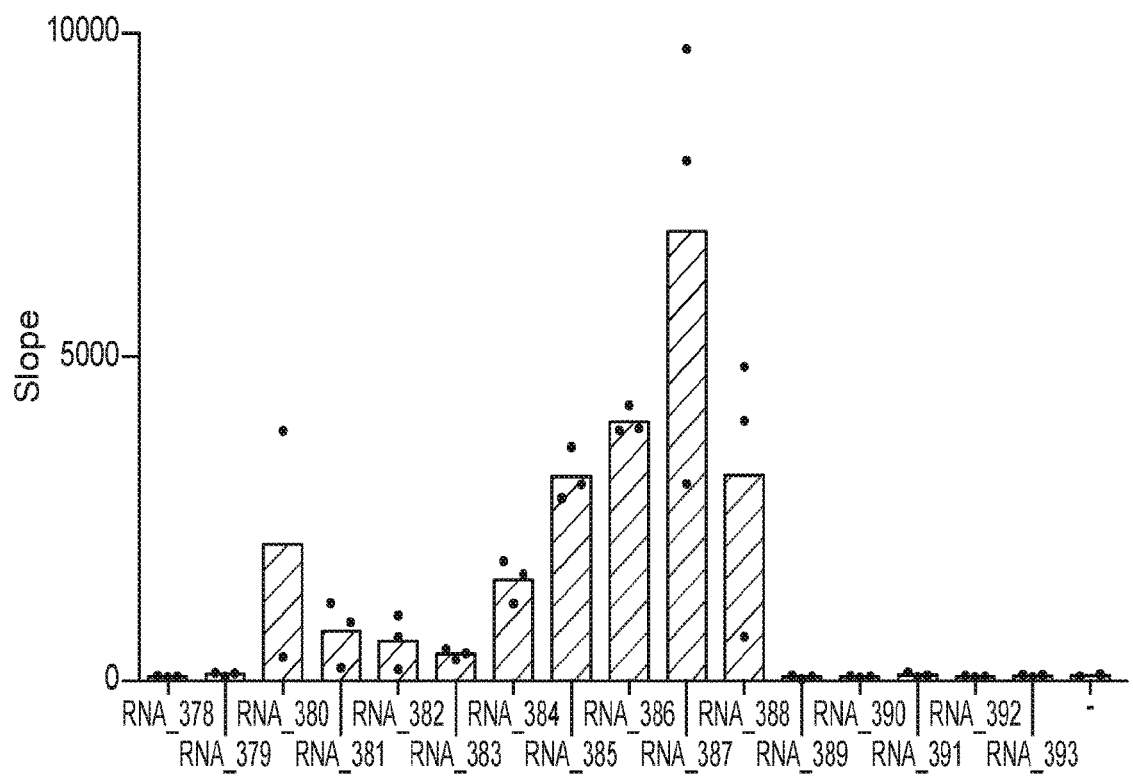
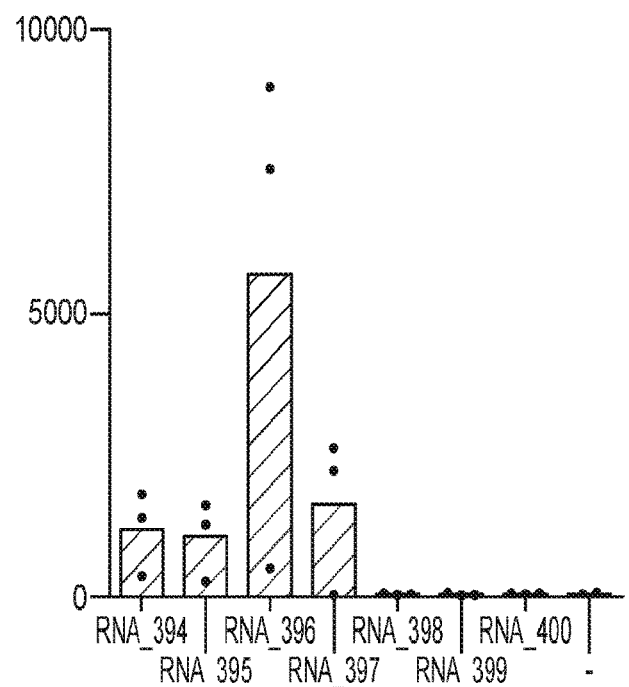
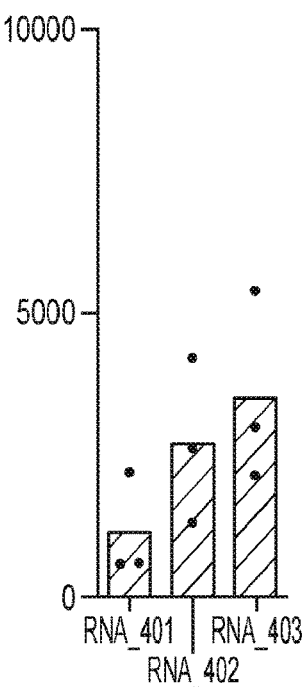

FIG. 26

Table 3

| RNA | RNA SEQUENCE | SEQ ID NO: |
|---|---|---|
| RNA_378 | atcaataccaaactctgg | 257 |
| RNA_379 | AAGGCatcaataccaaactctgg | 258 |
| RNA_380 | GCGATGAAGGCatcaataccaaactctgg | 259 |
| RNA_381 | CAGAGCGATGAAGGCatcaataccaaactctgg | 260 |
| RNA_382 | ACCCGTAAAGCAGAGCGATGAAGGCatcaataccaaactctgg | 261 |
| RNA_383 | GCGATGAAGGCatcaataccaaactctggCGG | 262 |
| RNA_384 | GCGATGAAGGCatcaataccaaactctggCG | 263 |
| RNA_385 | GCGATGAAGGCatcaataccaaactctggC | 264 |
| RNA_386 | GCGATGAAGGCatcaataccaaactctgg | 265 |
| RNA_387 | GCGATGAAGGCatcaataccaaactctg | 266 |
| RNA_388 | GCGATGAAGGCatcaataccaaactct | 267 |
| RNA_389 | atcaataccaaactctggACCCGTAAAGCAGAGCGATGAAGGC | 268 |
| RNA_390 | ACCCGTAAAGCAGAGCGATGGGCGTatcaataccaaactctgg | 269 |
| RNA_391 | GCGATGGGCGTatcaataccaaactctgg | 270 |
| RNA_392 | ACCCGTAAAGCAGAGCGATGAAGGCatcaataccaaactctggACCCGTAAAGCAGAGCGATGAAGGC | 271 |
| RNA_393 | GCCTTCATCGCTCTGCTTTACGGGTccagagtttggtattgatGCCTTCATCGCTCTGCTTTACGGGT | 272 |
| RNA_394 | CTTAGTTAAGGATGTTCCAGGTTCTTTCGGGAGCCTTGGCCTTCTCCCTT | 273 |
| RNA_395 | CCGACTTCGCTGATAAAAATCTTAGTTAAGGATGTTCCAGGTTCTTTCGGGAGCCTTGGCCTTCTCCCTT | 274 |
| RNA_396 | CTTAGTTAAGGATGTTCCAGGTTCTTTCGGGAGCCTTGGCCTTCTCCCTTAACCTATGCCACTAATGATT | 275 |
| RNA_397 | CTTAGTTAAGGATGTTCCAGGTTCTTTCGGGAGCCTTGGCCTTCTCCCTTAACCTATGCCACTAATGATTAGGAACACGATGAATGAAAGAAGACGGCGA | 276 |
| RNA_398 | CTTAGTTAAGGATGTTCCAGGTTCTTTCGGGAACGCCGGCCTTCTCCCTT | 277 |
| RNA_399 | CTTAGTTAAGGATGTTCCAGGTTCTTTCGGGAGCCTTGACGCCCTCCCTT | 278 |

FIG. 26 (Cont.)

| RNA_400 | CTTAGTTAAGGATGTTCCAGGTTCTTTCGGGAACG CCGACGCCCTCCCTT | 279 |
|---|---|---|
| RNA_401 | GGAGAGCAACTACCCGTAAAGCAGAGCGATGAAG GCatcaataccaaactctggACCCGTAAAGCAGAGCGAT GAAGGCttgtcgtgtgagcagcttACCCGTAAAGCAGAG CGATGAAGGCACATTGGCCGACTTCGCTGATAAAA ATCTTAGTTAAGGATGTTCCAGGTTCTTTCGGGAG CCTTGGCCTTCTCCCTTAACCT | 280 |
| RNA_402 | CTTAGTTAAGGATGTTCCAGGTTCTTTCGGGAGCC TTGGCCTTCTCCCTTAACCTATGCCACTAATGATTg aaaGCGATGAAGGCatcaataccaaactctgg | 281 |
| RNA_403 | CTTAGTTAAGGATGTTCCAGGTTCTTTCGGGAGCC TTGGCCTTCTCCCTTAACCTATGCCACTAATGATTg aaaaaaaaaaaGCGATGAAGGCatcaataccaaactctgg | 282 |
| RNA_404 | GGAGAGCAACTACCCGTAAAGCAGAGCGATGAAG GCatcaataccaaactctggACCCGTAAAGCAGAGCGAT GAAGGCttgtcgtgtgagcagcttACCCGTAAAGCAGAG CGATGAAGGCA | 283 |

FIG. 27

| DNA substrates | DNA Sequence | SEQ ID NO: |
|---|---|---|
| LβH_4421_CasY target 1 | GCCTGCCCGcagactaATCAATACCAAACTCTGGCGGCGTAAACTTTCCAGTC | 284 |
| LβH_4422_CasY Target 2 | GCCTGCCCGcagactaTACTGTTATTGTTGTACTCGGCGTAAACTTTCCAGTC | 285 |
| LβH_4423_CasY target 1 PAM TG | GCCTGCCCGcagactgATCAATACCAAACTCTGGCGGCGTAAACTTTCCAGTC | 286 |
| LβH_4424_CasY target 1 PAM TC | GCCTGCCCGcagactcATCAATACCAAACTCTGGCGGCGTAAACTTTCCAGTC | 287 |
| LβH_4425_CasY target 1 PAM TT | GCCTGCCCGcagacttATCAATACCAAACTCTGGCGGCGTAAACTTTCCAGTC | 288 |
| LβH_4426_CasY target 1 PAM AA | GCCTGCCCGcagacaaATCAATACCAAACTCTGGCGGCGTAAACTTTCCAGTC | 289 |
| LβH_4427_CasY target 1 PAM GA | GCCTGCCCGcagacGAATCAATACCAAACTCTGGCGGCGTAAACTTTCCAGTC | 290 |
| LβH_4428_CasY target 1 PAM CA | GCCTGCCCGcagaccaATCAATACCAAACTCTGGCGGCGTAAACTTTCCAGTC | 291 |
| LβH_4429_CasY target 1 PAM CC | GCCTGCCCGcagacccATCAATACCAAACTCTGGCGGCGTAAACTTTCCAGTC | 292 |
| LβH_4430_CasY target 1 PAM TTa | GCCTGCCCGcagattgATCAATACCAAACTCTGGCGGCGTAAACTTTCCAGTC | 293 |
| LβH_4431_CasY target 1 PAM gTa | GCCTGCCCGcagagtaATCAATACCAAACTCTGGCGGCGTAAACTTTCCAGTC | 294 |
| LβH_4432_CasY target 1 PAM aTa | GCCTGCCCGcagaataATCAATACCAAACTCTGGCGGCGTAAACTTTCCAGTC | 295 |
| LβH_4433_CasY target 1 MM 1-2 | GCCTGCCCGcagactaGCCAATACCAAACTCTGGCGGCGTAAACTTTCCAGTC | 296 |
| LβH_4434_CasY target 1 MM 3-4 | GCCTGCCCGcagactaATTGATACCAAACTCTGGCGGCGTAAACTTTCCAGTC | 297 |
| LβH_4435_CasY target 1 MM 5-6 | GCCTGCCCGcagactaATCAGCACCAAACTCTGGCGGCGTAAACTTTCCAGTC | 298 |
| LβH_4436_CasY target 1 MM 7-8 | GCCTGCCCGcagactaATCAATGTCAAACTCTGGCGGCGTAAACTTTCCAGTC | 299 |
| LβH_4437_CasY target 1 MM 9-10 | GCCTGCCCGcagactaATCAATACTGAACTCTGGCGGCGTAAACTTTCCAGTC | 300 |
| LβH_4438_CasY target 1 MM 11-12 | GCCTGCCCGcagactaATCAATACCAGGCTCTGGCGGCGTAAACTTTCCAGTC | 301 |
| LβH_4439_CasY target 1 MM 13-14 | GCCTGCCCGcagactaATCAATACCAAATCCTGGCGGCGTAAACTTTCCAGTC | 302 |

FIG. 27 (Cont.)

| | | |
|---|---|---|
| LβH_4440_CasY target 1 MM 15-16 | GCCTGCCCGcagactaATCAATACCAAACTTCGGCGGCGTAAACTTTCCAGTC | 303 |
| LβH_4441_CasY target 1 MM 17-18 | GCCTGCCCGcagactaATCAATACCAAACTCTAACGGCGTAAACTTTCCAGTC | 304 |
| LβH_4442_CasY target 1 MM 19-20 | GCCTGCCCGcagactaATCAATACCAAACTCTGGTAGCGTAAACTTTCCAGTC | 305 |
| LβH_4443_CasY target 1 | GACTGGAAAGTTTACGCCGCCAGAGTTTGGTATTGATtagtctgCGGGCAGGC | 306 |
| LβH_4444_CasY Target 2 | GACTGGAAAGTTTACGCCGAGTACAACAATAACAGTAtagtctgCGGGCAGGC | 307 |
| LβH_4445_CasY target 1 PAM TG | GACTGGAAAGTTTACGCCGCCAGAGTTTGGTATTGATcagtctgCGGGCAGGC | 308 |
| LβH_4446_CasY target 1 PAM TC | GACTGGAAAGTTTACGCCGCCAGAGTTTGGTATTGATgagtctgCGGGCAGGC | 309 |
| LβH_4447_CasY target 1 PAM TT | GACTGGAAAGTTTACGCCGCCAGAGTTTGGTATTGATaagtctgCGGGCAGGC | 310 |
| LβH_4448_CasY target 1 PAM AA | GACTGGAAAGTTTACGCCGCCAGAGTTTGGTATTGATttgtctgCGGGCAGGC | 311 |
| LβH_4449_CasY target 1 PAM GA | GACTGGAAAGTTTACGCCGCCAGAGTTTGGTATTGATTCgtctgCGGGCAGGC | 312 |
| LβH_4450_CasY target 1 PAM CA | GACTGGAAAGTTTACGCCGCCAGAGTTTGGTATTGATtggtctgCGGGCAGGC | 313 |
| LβH_4451_CasY target 1 PAM CC | GACTGGAAAGTTTACGCCGCCAGAGTTTGGTATTGATgggtctgCGGGCAGGC | 314 |
| LβH_4452_CasY target 1 PAM TTa | GACTGGAAAGTTTACGCCGCCAGAGTTTGGTATTGATcaatctgCGGGCAGGC | 315 |
| LβH_4453_CasY target 1 PAM gTa | GACTGGAAAGTTTACGCCGCCAGAGTTTGGTATTGATtactctgCGGGCAGGC | 316 |
| LβH_4454_CasY target 1 PAM aTa | GACTGGAAAGTTTACGCCGCCAGAGTTTGGTATTGATtattctgCGGGCAGGC | 317 |
| LβH_4455_CasY target 1 MM 1-2 | GACTGGAAAGTTTACGCCGCCAGAGTTTGGTATTGGCtagtctgCGGGCAGGC | 318 |
| LβH_4456_CasY target 1 MM 3-4 | GACTGGAAAGTTTACGCCGCCAGAGTTTGGTATCAATtagtctgCGGGCAGGC | 319 |
| LβH_4457_CasY target 1 MM 5-6 | GACTGGAAAGTTTACGCCGCCAGAGTTTGGTGCTGATtagtctgCGGGCAGGC | 320 |
| LβH_4458_CasY target 1 MM 7-8 | GACTGGAAAGTTTACGCCGCCAGAGTTTGACATTGATtagtctgCGGGCAGGC | 321 |
| LβH_4459_CasY target 1 MM 9-10 | GACTGGAAAGTTTACGCCGCCAGAGTTCAGTATTGATtagtctgCGGGCAGGC | 322 |

FIG. 27 (Cont.)

| LβH_4460_CasY target 1 MM 11-12 | GACTGGAAAGTTTACGCCGCCAGAGCCTGGTATTGATtagtctgCGGGCAGGC | 323 |
|---|---|---|
| LβH_4461_CasY target 1 MM 13-14 | GACTGGAAAGTTTACGCCGCCAGGATTTGGTATTGATtagtctgCGGGCAGGC | 324 |
| LβH_4462_CasY target 1 MM 15-16 | GACTGGAAAGTTTACGCCGCCGAAGTTTGGTATTGATtagtctgCGGGCAGGC | 325 |
| LβH_4463_CasY target 1 MM 17-18 | GACTGGAAAGTTTACGCCGTTAGAGTTTGGTATTGATtagtctgCGGGCAGGC | 326 |
| LβH_4464_CasY target 1 MM 19-20 | GACTGGAAAGTTTACGCTACCAGAGTTTGGTATTGATtagtctgCGGGCAGGC | 327 |

FIG. 29

>Cas14a.1|gwa1_scaffold_1795_curated|25635..27224|revcom
PEEKTSKLKPNSINLAANYDANEKFNCKECKFHPFKNKKRYEFNFYNNLHGCKSCTKST
NNPAVKRIEIGYQKLKFEIKNQMEAYPWFGRLRINFYSDEKRKMSELNEMQVTGVKNKI
FFDAIECAWREILKKRFRESKETLITIPKLNKAGHGARKHRNKKLLIRRRAFMKKNFH
FLDNDSISYRSFANNIACVLPSKVGVDIGGIISPDVGKDIKPVDISLNLMWASKEGIKS
GRKVEIYSTQYDGNMVKKIEAETGEDKSWGKNRKRRQTSLLLSIPKPSKQVQEFDFKEW
PRYKDIEKKVQWRGFPIKIIFDSNHNSIEFGTYQGGKQKVLPIPFNDSKTTPLGSKMNK
LEKLRFNSKIKSRLGSAIAANKFLEAARTYCVDSLYHEVSSANAIGKGKIFIEYYLEIL
SQNYIEAAQKQLQRFIESIEQWFVADPFQGRLKQYFKDDLKRAKCFLCANREVQTTCYA
AVKLHKSCAEKVKDKNKELAIKERNNKEDAVIKEVEASNYPRVIRLKLTKTITNKAM
(SEQ ID NO:328)

>Cas14a.2|gwa2_scaffold_18027_curated|7105..8628
ELIVNENKDPLNIGKTAKAVFKEIDPTSINRAANYDASIELACKECKFKPFNNTKRHDF
SFYSNWHRCSPNSCLQSTYRAKIRKTEIGYEKLKNEILNQMQYYPWFGRLYQNFFNDQR
DKMTSLDEIQVTGVQNKIFFNTVEKAWREIIKKRFRDNKETMRTIPDLKNKSGHGSRKL
SNKSLLRRRFAFAQKSFKLVDNSDVSYRAFSNNVACVLPSKIGVDIGGIINKDLKREYI
PQEITFNVFWKQHDGLKKGRNIEIHSVQYKGEIVKRIEADTGEDKAWGKNRQRRFTSLI
LKITPKQGGKKIWKFPEKKNASDYEYFPIPIEFILDNGDASIKFGGEEGEVGKQKHLLI
PFNDSKATPLSSKQMLLETSRFNAEVKSTIGLALYANYFVSYARNYVIKSTYHKNSKKG
QIVTEIYLESISQNFVRAIQRQLQSLMLNLKDWGFMQTHKKELKKYFGSDLEGSKGGQK
RREKEEKIEKEIEASYLPRLIRLSLTKSVTKAEEM (SEQ ID NO:329)

>Cas14a.3|rifcsphigho2_02_scaffold_2167_curated|30296..31798|revcom
KEPLNIGKTAKAVFKEIDPTSLNRAANYDASIELNCKECKFKPFKNVKRYEFNFYNNWY
RCNPNSCLQSTYKAQVRKVEIGYEKLKNEILTQMQYYPWFGRLYQNFFHDERDKMTSLD
EIQVIGVQNKVFFNTVEKAWREIIKKRFKDNKETMETIPELKHAAGHGKRKLSNKSLLR
RRFAFVQKSFKFVDNSDVSYRSFSNNIACVLPSRIGVDLGGVISRNPKREYIPQEISFN
AFWKQHEGLKKGRNIEIQSVQYKGETVKRIEADTGEDKAWGKNRQRRFTSLILKLVPKQ
GGKKVWKYPEKRNEGNYEYFPIPIEFILDSGETSIRFGGDEGEAGKQKHLVIPFNDSKA
TPLASQQTLLENSRFNAEVKSCIGLAIYANYFYGYARNYVISSIYHKNSKNGQAITAIY
LESIAHNYVKAIERQLQNLLLNLRDFSFMESHKKELKKYFGGDLEGTGGAQKRREKEEK
IEKEIEQSYLPRLIRLSLTKMVTKQVEM (SEQ ID NO:330)

FIG. 29 (Cont.)

>Cas14a.4|CG10_big_fil_rev_8_21_14_0.10_scaffold_20906_cura
ted|649..2829
SESENKIIEQYYAFLYSFRDKYEKPEFKNRGDIKRKLQNKWEDFLKEQNLKNDKKLSNY
IFSNRNFRRSYDREEENEEGIDEKKSKPKRINCFEKEKNLKDQYDKDAINASANKDGAQ
KWGCFECIFFPMYKIESGDPNKRIIINKTRFKLFDFYLNLKGCKSCLRSTYHPYRSNVY
IESNYDKLKREIGNFLQQKNIFQRMRKAKVSEGKYLTNLDEYRLSCVAMHFKNRWLFFD
SIQKVLRETIKQRLKQMRESYDEQAKTKRSKGHGRAKYEDQVRMIRRRAYSAQAHKLLD
NGYITLFDYDDKEINKVCLTAINQEGFDIGGYLNSDIDNVMPPIEISFHLKWKYNEPIL
NIESPFSKAKISDYLRKIREDLNLERGKEGKARSKKNVRRKVLASKGEDGYKKIFTDFF
SKWKEELEGNAMERVLSQSSGDIQWSKKKRIHYTTLVLNINLLDKKGVGNLKYYEIAEK
TKILSFDKNENKFWPITIQVLLDGYEIGTEYDEIKQLNEKTSKQFTIYDPNTKIIKIPF
TDSKAVPLGMLGINIATLKTVKKTERDIKVSKIFKGGLNSKIVSKIGKGIYAGYFPTVD
KEILEEVEEDTLDNEFSSKSQRNIFLKSIIKNYDKMLKEQLFDFYSFLVRNDLGVRFLT
DRELQNIEDESFNLEKRFFETDRDRIARWFDNTNTDDGKEKFKKLANEIVDSYKPRLIR
LPVVRVIKRIQPVKQREM (SEQ ID NO:331)

>Cas14a.5|rifcsplowo2_01_scaffold_34461_curated|4968..6521
KYSTRDFSELNEIQVTACKQDEFFKVIQNAWREIIKKRFLENRENFIEKKIFKNKKGRG
KRQESDKTIQRNRASVMKNFQLIENEKIILRAPSGHVACVFPVKVGLDIGGFKTDDLEK
NIFPPRTITINVFWKNRDRQRKGRKLEVWGIKARTKLIEKVHKWDKLEEVKKKRLKSLE
QKQEKSLDNWSEVNNDSFYKVQIDELQEKIDKSLKGRTMNKILDNKAKESKEAEGLYIE
WEKDFEGEMLRRIEASTGGEEKWGKRRQRRHTSLLLDIKNNSRGSKEIINFYSYAKQGK
KEKKIEFFPFPLTITLDAEEESPLNIKSIPIEDKNATSKYFSIPFTETRATPLSILGDR
VQKFKTKNISGAIKRNLGSSISSCKIVQNAETSAKSILSLPNVKEDNNMEIFINTMSKN
YFRAMMKQMESFIFEMEPKTLIDPYKEKAIKWFEVAASSRAKRKLKKLSKADIKKSELL
LSNTEEFEKEKQEKLEALEKEIEEFYLPRIVRLQLTKTILETPVM (SEQ ID
NO:332)

>Cas14a.6|3300012359.a|Ga0137385_10000156|41289..42734
KKLQLLGHKILLKEYDPNAVNAAANFETSTAELCGQCKMKPFKNKRRFQYTFGKNYHGC
LSCIQNVYYAKKRIVQIAKEELKHQLTDSIASIPYKYTSLFSNTNSIDELYILKQERAA
FFSNTNSIDELYITGIENNIAFKVISAIWDEIIKKRRQRYAESLTDTGTVKANRGHGGT
AYKSNTRQEKIRALQKQTLHMVTNPYISLARYKNNYIVATLPRTIGMHIGAIKDRDPQK
KLSDYAINFNVFWSDDRQLIELSTVQYTGDMVRKIEAETGENNKWGENMKRTKTSLLLE
ILTKKTTDELTFKDWAFSTKKEIDSVTKKTYQGFPIGIIFEGNESSVKFGSQNYFPLPF
DAKITPPTAEGFRLDWLRKGSFSSQMKTSYGLAIYSNKVTNAIPAYVIKNMFYKIARAE
NGKQIKAKFLKKYLDIAGNNYVPFIIMQHYRVLDTFEEMPISQPKVIRLSLTKTQHIII
KKDKTDSKM (SEQ ID NO:333)

FIG. 29 (Cont.)

>Cas14b.1|rifcsplowo2_01_scaffold_239_curated|54653..56257
NTSNLINLGKKAINISANYDANLEVGCKNCKFLSSNGNFPRQTNVKEGCHSCEKSTYEP
SIYLVKIGERKAKYDVLDSLKKFTFQSLKYQSKKSMKSRNKKPKELKEFVIFANKNKAF
DVIQKSYNHLILQIKKEINRMNSKKRKKNHKRRLFRDREKQLNKLRLIESSNLFLPREN
KGNNHVFTYVAIHSVGRDIGVIGSYDEKLNFETELTYQLYFNDDKRLLYAYKPKQNKII
KIKEKLWNLRKEKEPLDLEYEKPLNKSITFSIKNDNLFKVSKDLMLRRAKFNIQGKEKL
SKEERKINRDLIKIKGLVNSMSYGRFDELKKEKNIWSPHIYREVRQKEIKPCLIKNGDR
IEIFEQLKKKMERLRRFREKRQKKISKDLIFAERIAYNFHTKSIKNTSNKINIDQEAKR
GKASYMRKRIGYETFKNKYCEQCLSKGNVYRNVQKGCSCFENPFDWIKKGDENLLPKKN
EDLRVKGAFRDEALEKQIVKIAFNIAKGYEDFYDNLGESTEKDLKLKFKVGTTINEQES
LKL (SEQ ID NO:334)

>Cas14b.2|rifcsplowo2_01_scaffold_282_curated|77370..78983
TSNPIKLGKKAINISANYDSNLQIGCKNCKFLSYNGNFPRQTNVKEGCHSCEKSTYEPP
VYTVRIGERRSKYDVLDSLKKFIFLSLKYRQSKKMKTRSKGIRGLEEFVISANLKKAMD
VIQKSYRHLILNIKNEIVRMNGKKRNKNHKRLLFRDREKQLNKLRLIEGSSFFKPPTVK
GDNSIFTCVAIHNIGRDIGIAGDYFDKLEPKIELTYQLYYEYNPKKESEINKRLLYAYK
PKQNKIIEIKEKLWNLRKEKSPLDLEYEKPLTKSITFLVKRDGVFRISKDLMLRKAKFI
IQGKEKLSKEERKINRDLIKIKSNIISLTYGRFDELKKDKTIWSPHIFRDVKQGKITPC
IERKGDRMDIFQQLRKKSERLRENRKKRQKKISKDLIFAERIAYNFHTKSIKNTSNLIN
IKHEAKRGKASYMRKRIGNETFRIKYCEQCFPKNNVYKNVQKGCSCFEDPFEYIKKGNE
DLIPNKQDLKAKGAFRDDALEKQIIKVAFNIAKGYEDFYENLKKTTEKDIRLKFKVGT
IISEEM (SEQ ID NO:335)

>Cas14b.3|rifcsphigho2_01_scaffold_36781_curated|2592..4217
NNSINLSKKAINISANYDANLQVRCKNCKFLSSNGNFPRQTDVKEGCHSCEKSTYEPPV
YDVKIGEIKAKYEVLDSLKKFTFQSLKYQLSKSMKFRSKKIKELKEFVIFAKESKALNV
INRSYKHLILNIKNDINRMNSKKRIKNHKGRLFLDRQKQLSKLKLIEGSSFFVPAKNVG
NKSVFTCVAIHSIGRDIGIAGLYDSFTKPVNEITYQIFFSGERRLLYAYKPKQLKILSI
KENLWSLKNEKKPLDLLYEKPLGKNLNFNVKGGDLFRVSKDLMIRNAKFNVHGRQRLSD
EERLINRNFIKIKGEVVSLSYGRFEELKKDRKLWSPHIFKDVRQNKIKPCLVMQGQRID
IFEQLKRKLELLKKIRKSRQKKLSKDLIFGERIAYNFHTKSIKNTSNKINIDSDAKRGR
ASYMRKRIGNETFKLKYCDVCFPKANVYRRVQNGCSCSENPYNYIKKGDKDLLPKKDEG
LAIKGAFRDEKLNKQIIKVAFNIAKGYEDFYDDLKKRTEKDVDLKFKIGTTVLDQKPME
IFDGIVITWL (SEQ ID NO:336)

FIG. 29 (Cont.)

>Cas14b.4|cg1_0.2_scaffold_785_c_curated|32521..34155
LLTTVVETNNLAKKAINVAANFDANIDRQYYRCTPNLCRFIAQSPRETKEKDAGCSSCT
QSTYDPKVYVIKIGKLLAKYEILKSLKRFLFMNRYFKQKKTERAQQKQKIGTELNEMSI
FAKATNAMEVIKRATKHCTYDIIPETKSLQMLKRRRHRVKVRSLLKILKERRMKIKKIP
NTFIEIPKQAKKNKSDYYVAAALKSCGIDVGLCGAYEKNAEVEAEYTYQLYYEYKGNSS
TKRILYCYNNPQKNIREFWEAFYIQGSKSHVNTPGTIRLKMEKFLSPITIESEALDFRV
WNSDLKIRNGQYGFIKKRSLGKEAREIKKGMGDIKRKIGNLTYGKSPSELKSIHVYRTE
RENPKKPRAARKKEDNFMEIFEMQRKKDYEVNKKRRKEATDAAKIMDFAEEPIRHYHTN
NLKAVRRIDMNEQVERKKTSVFLKRIMQNGYRGNYCRKCIKAPEGSNRDENVLEKNEGC
LDCIGSEFIWKKSSKEKKGLWHTNRLLRRIRLQCFTTAKAYENFYNDLFEKKESSLDII
KLKVSITTKSM (SEQ ID NO:337)

>Cas14b.5|rifcsphigho2_02_scaffold_55589_curated|1904..3598
ASTMNLAKQAINFAANYDSNLEIGCKGCKFMSTWSKKSNPKFYPRQNNQANKCHSCTYS
TGEPEVPIIEIGERAAKYKIFTALKKFVFMSVAYKERRRQRFKSKKPKELKELAICSNR
EKAMEVIQKSVVHCYGDVKQEIPRIRKIKVLKNHKGRLFYKQKRSKIKIAKLEKGSFFK
TFIPKVHNNGCHSCHEASLNKPILVTTALNTIGADIGLINDYSTIAPTETDISWQVYYE
FIPNGDSEAVKKRLLYFYKPKGALIKSIRDKYFKKGHENAVNTGFFKYQGKIVKGPIKF
VNNELDFARKPDLKSMKIKRAGFAIPSAKRLSKEDREINRESIKIKNKIYSLSYGRKKT
LSDKDIIKHLYRPVRQKGVKPLEYRKAPDGFLEFFYSLKRKERRLRKQKEKRQKDMSEI
IDAADEFAWHRHTGSIKKTTNHINFKSEVKRGKVPIMKKRIANDSFNTRHCGKCVKQGN
AINKYYIEKQKNCFDCNSIEFKWEKAALEKKGAFKLNKRLQYIVKACFNVAKAYESFYE
DFRKGEEESLDLKFKIGTTTTLKQYPQNKARAM (SEQ ID NO:338)

>Cas14b.6|CG03_land_8_20_14_0.80_scaffold_2214_curated|6634
..8466|revcom
HSHNLMLTKLGKQAINFAANYDANLEIGCKNCKFLSYSPKQANPKKYPRQTDVHEDGNI
ACHSCMQSTKEPPVYIVPIGERKSKYEILTSLNKFTFLALKYKEKKRQAFRAKKPKELQ
ELAIAFNKEKAIKVIDKSIQHLILNIKPEIARIQRQKRLKNRKGKLLYLHKRYAIKMGL
IKNGKYFKVGSPKKDGKKLLVLCALNTIGRDIGIIGNIEENNRSETEITYQLYFDCLDA
NPNELRIKEIEYNRLKSYERKIKRLVYAYKPKQTKILEIRSKFFSKGHENKVNTGSFNF
ENPLNKSISIKVKNSAFDKIGAPFIMLRNGKFHIPTKKRLSKEEREINRTLSKIKGRV
FRLTYGRNISEQGSKSLHIYRKERQHPKLSLEIRKQPDSFIDEFEKLRLKQNFISKLKK
QRQKKLADLLQFADRIAYNYHTSSLEKTSNFINYKPEVKRGRTSYIKKRIGNEGFEKLY
CETCIKSNDKENAYAVEKEELCFVCKAKPFTWKKTNKDLGIFKYPSRIKDFIRAAFTV
AKSYNDFYENLKKKDLKNEIFLKFKIGLILSHEKKNHISIAKSVAEDERISGKSIKNIL
NKSIKLEKNCYSCFFHKEDM (SEQ ID NO:339)

FIG. 29 (Cont.)

>Cas14b.7|3300013125.a|Ga0172369_10000737|994..2652|revcom
SLERVIDKRNLAKKAINIAANFDANINKGFYRCETNQCMFIAQKPRKTNNTGCSSCLQS
TYDPVIYVVKVGEMLAKYEILKSLKRFVFMNRSFKQKKTEKAKQKERIGGELNEMSIFA
NAALAMGVIKRAIRHCHVDIRPEINRLSELKKTKHRVAAKSLVKIVKQRKTKWKGIPNS
FIQIPQKARNKDADFYVASALKSGGIDIGLCGTYDKKPHADPRWTYQLYFDTEDESEKR
LLYCYNDPQAKIRDFWKTFYERGNPSMVNSPGTIEFRMEGFFEKMTPISIESKDFDFRV
WNKDLLIRRGLYEIKKRKNLNRKAREIKKAMGSVKRVLANMTYGKSPTDKKSIPVYRVE
REKPKKPRAVRKEENELADKLENYRREDFLIRNRRKREATEIAKIIDAAEPPIRHYHTN
HLRAVKRIDLSKPVARKNTSVFLKRIMQNGYRGNYCKKCIKGNIDPNKDECRLEDIKKC
ICCEGTQNIWAKKEKLYTGRINVLNKRIKQMKLECFNVAKAYENFYDNLAALKEGDLKV
LKLKVSIPALNPEASDPEEDM (SEQ ID NO:340)

>Cas14b.8|3300013125.a|Ga0172369_10010464|885..2489|revcom
NASINLGKRAINLSANYDSNLVIGCKNCKFLSFNGNFPRQTNVREGCHSCDKSTYAPEV
YIVKIGERKAKYDVLDSLKKFTFQSLKYQIKKSMRERSKKPKELLEFVIFANKDKAFNV
IQKSYEHLILNIKQEINRMNGKKRIKNHKKRLFKDREKQLNKLRLIGSSSLFFPRENKG
DKDLFTYVAIHSVGRDIGVAGSYESHIEPISDLTYQLFINNEKRLLYAYKPKQNKIIEL
KENLWNLKKEKKPLDLEFTKPLEKSITFSVKNDKLFKVSKDLMLRQAKFNIQGKEKLSK
EERQINRDFSKIKSNVISLSYGRFEELKKEKNIWSPHIYREVKQKEIKPCIVRKGDRIE
LFEQLKRKMDKLKKFRKERQKKISKDLNFAERIAYNFHTKSIKNTSNKINIDQEAKRGK
ASYMRKRIGNESFRKKYCEQCFSVGNVYHNVQNGCSCFDNPIELIKKGDEGLIPKGKED
RKYKGALRDDNLQMQIIRVAFNIAKGYEDFYNNLKEKTEKDLKLFKIGTTISTQESNN
KEM (SEQ ID NO:341)

>Cas14b.9|3300013127.a|Ga0172365_10004421|633..2366|revcom
SNLIKLGKQAINFAANYDANLEVGCKNCKFLSSTNKYPRQTNVHLDNKMACRSCNQSTM
EPAIYIVRIGEKKAKYDIYNSLTKFNFQSLKYKAKRSQRFKPKQPKELQELSIAVRKEK
ALDIIQKSIDHLIQDIRPEIPRIKQQKRYKNHVGKLFYLQKRRKNKLNLIGKGSFFKVF
SPKEKKNELLVICALTNIGRDIGLIGNYNTIINPLFEVTYQLYYDYIPKKNNKNVQRRL
LYAYKSKNEKILKLKEAFFKRGHENAVNLGSFSYEKPLEKSLTLKIKNDKDDFQVSPSL
RIRTGRFFVPSKRNLSRQEREINRRLVKIKSKIKNMTYGKFETARDKQSVHIFRLERQK
EKLPLQFRKDEKEFMEEFQKLKRRTNSLKKLRKSRQKKLADLLQLSEKVVYNNHTGTLK
KTSNFLNFSSSVKRGKTAYIKELLGQEGFETLYCSNCINKGQKTRYNIETKEKCFSCKD
VPFVWKKKSTDKDRKGAFLFPAKLKDVIKATFTVAKAYEDFYDNLKSIDEKKPYIKFKI
GLILAHVRHEHKARAKEEAGQKNIYNKPIKIDKNCKECFFFKEEAM (SEQ ID NO:
342)

FIG. 29 (Cont.)

>Cas14b.10|CG08_land_8_20_14_0.20_scaffold_1609_curated|6134..7975
NTTRKKFRKRTGFPQSDNIKLAYCSAIVRAANLDADIQKKHNQCNPNLCVGIKSNEQSR
KYEHSDRQALLCYACNQSTGAPKVDYIQIGEIGAKYKILQMVNAYDFLSLAYNLTKLRN
GKSRGHQRMSQLDEVVIVADYEKATEVIKRSINHLLDDIRGQLSKLKKRTQNEHITEHK
QSKIRRKLRKLSRLLKRRRWKWGTIPNPYLKNWVFTKKDPELVTVALLHKLGRDIGLVN
RSKRRSKQKLLPKVGFQLYYKWESPSLNNIKKSKAKKLPKRLLIPYKNVKLFDNKQKLE
NAIKSLLESYQKTIKVEFDQFFQNRTEEIIAEEQQTLERGLLKQLEKKKNEFASQKKAL
KEEKKKIKEPRKAKLLMEESRSLGFLMANVSYALFNTTIEDLYKKSNVVSGCIPQEPVV
VFPADIQNKGSLAKILFAPKDGFRIKFSGQHLTIRTAKFKIRGKEIKILTKTKREILKN
IEKLRRVWYREQHYKLKLFGKEVSAKPRFLDKRKTSIERRDPNKLADQTDDRQAELRNK
EYELRHKQHKMAERLDNIDTNAQNLQTLSFWVGEADKPPKLDEKDARGFGVRTCISAWK
WFMEDLLKKQEEDPLLKLKLSIM (SEQ ID NO:343)

>Cas14b.11|CG_4_10_14_0.8_um_filter_scaffold_20762_curated|1372..3219
PKKPKFQKRTGFPQPDNLRKEYCLAIVRAANLDADFEKKCTKCEGIKTNKKGNIVKGRT
YNSADKDNLLCYACNISTGAPAVDYVFVGALEAKYKILQMVKAYDFHSLAYNLAKLWKG
RGRGHQRMGGLNEVVIVSNNEKALDVIEKSLNHFHDEIRGELSRLKAKFQNEHLHVHKE
SKLRRKLRKISRLLKRRRWKWDVIPNSYLRNFTFTKTRPDFISVALLHRVGRDIGLVTK
TKIPKPTDLLPQFGFQIYYTWDEPKLNKLKKSRLRSEPKRLLVPYKKIELYKNKSVLEE
AIRHLAEVYTEDLTICFKDFFETQKRKFVSKEKESLKRELLKELTKLKKDFSERKTALK
RDRKEIKEPKKAKLLMEESRSLGFLAANTSYALFNLIAADLYTKSKKACSTKLPRQLST
ILPLEIKEHKSTTSLAIKPEEGFKIRFSNTHLSIRTPKFKMKGADIKALTKRKREILKN
ATKLEKSWYGLKHYKLKLYGKEVAAKPRFLDKRNPSIDRRDPKELMEQIENRRNEVKDL
EYEIRKGQHQMAKRLDNVDTNAQNLQTKSFWVGEADKPPELDSMEAKKLGLRTCISAWK
WFMKDLVLLQEKSPNLKLKLSLTEM (SEQ ID NO:344)

>Cas14b.12|CG22_combo_CG10-13_8_21_14_all_scaffold_2003_curated|553..2880|revcom
KFSKRQEGFLIPDNIDLYKCLAIVRSANLDADVQGHKSCYGVKKNGTYRVKQNGKKGVK
EKGRKYVFDLIAFKGNIEKIPHEAIEEKDQGRVIVLGKFNYKLILNIEKNHNDRASLEI
KNKIKKLVQISSLETGEFLSDLLSGKIGIDEVYGIIEPDVFSGKELVCKACQQSTYAPL
VEYMPVGELDAKYKILSAIKGYDFLSLAYNLSRNRANKKRGHQKLGGGELSEVVISANY
DKALNVIKRSINHYHVEIKPEISKLKKKMQNEPLKVMKQARIRRELHQLSRKVKRLKWK
WGMIPNPELQNIIFEKKEKDFVSYALLHTLGRDIGLFKDTSMLQVPNISDYGFQIYYSW
EDPKLNSIKKIKDLPKRLLIPYKRLDFYIDTILVAKVIKNLIELYRKSYVYETFGEEYG
YAKKAEDILFDWDSINLSEGIEQKIQKIKDEFSDLLYEARESKRQNFVESFENILGLYD
KNFASDRNSYQEKIQSMIIKKQQENIEQKLKREFKEVIERGFEGMDQNKKYYKVLSPNI
KGGLLYTDTNNLGFFRSHLAFMLLSKISDDLYRKNNLVSKGGNKGILDQTPETMLTLEF
GKSNLPNISIKRKFFNIKYNSSWIGIRKPKFSIKGAVIREITKKVRDEQRLIKSLEGVW
HKSTHFKRWGKPRFNLPRHPDREKNNDDNLMESITSRREQIQLLLREKQKQQEKMAGRL
DKIDKEIQNLQTANFQIKQIDKKPALTEKSEGKQSVRNALSAWKWFMEDLIKYQKRTPI
LQLKLAKM (SEQ ID NO: 345)

FIG. 29 (Cont.)

>Cas14b.13|rifcsphigho2_01_scaffold_82367_curated|1523..3856|revcom
KFSKRQEGFVIPENIGLYKCLAIVRSANLDADVQGHVSCYGVKKNGTYVLKQNGKKSIR
EKGRKYASDLVAFKGDIEKIPFEVIEEKKKEQSIVLGKFNYKLVLDVMKGEKDRASLTM
KNKSKKLVQVSSLGTDEFLLTLLNEKFGIEEIYGIIEPEVFSGKKLVCKACQQSTYAPL
VEYMPVGELDSKYKILSAIKGYDFLSLAYNLARHRSNKKRGHQKLGGGELSEVVISANN
AKALNVIKRSLNHYYSEIKPEISKLRKKMQNEPLKVGKQARMRRELHQLSRKVKRLKWK
WGKIPNLELQNITFKESDRDFISYALLHTLGRDIGMFNKTEIKMPSNILGYGFQIYYDW
EEPKLNTIKKSKNTPKRILIPYKKLDFYNDSILVARAIKELVGLFQESYEWEIFGNEYN
YAKEAEVELIKLDEESINGNVEKKLQRIKENFSNLLEKAREKKRQNFIESFESIARLYD
ESFTADRNEYQREIQSFIIEKQKQSIEKKLKNEFKKIVEKKFNEQEQGKKHYRVLNPTI
INEFLPKDKNNLGFLRSKIAFILLSKISDDLYKKSNAVSKGGEKGIIKQQPETILDLEF
SKSKLPSINIKKKLFNIKYTSSWLGIRKPKFNIKGAKIREITRRVRDVQRTLKSAESSW
YASTHFRRWGFPRFNQPRHPDKEKKSDDRLIESITLLREQIQILLREKQKGQKEMAGRL
DDVDKKIQNLQTANFQIKQTGDKPALTEKSAGKQSFRNALSAWKWFMENLLKYQNKTPD
LKLKIARTVM (SEQ ID NO: 346)

>Cas14b.14|gwc1_scaffold_8732_curated|2705..4537
KWIEPNNIDFNKCLAITRSANLDADVQGHKMCYGIKTNGTYKAIGKINKKHNTGIIEKR
RTYVYDLIVTKEKNEKIVKKTDFMAIDEEIEFDEKKEKLLKKYIKAEVLGTGELIRKDL
NDGEKFDDLCSIEEPQAFRRSELVCKACNQSTYASDIRYIPIGEIEAKYKILKAIKGYD
FLSLKYNLGRLRDSKKRGHQKMGQGELKEFVICANKEKALDVIKRSLNHYLNEVKDEIS
RLNKKMQNEPLKVNDQARWRRELNQISRRLKRLKWKWGEIPNPELKNLIFKSSRPEFVS
YALIHTLGRDIGLINETELKPNNIQEYGFQIYYKWEDPELNHIKKVKNIPKRFIIPYKN
LDLFGKYTILSRAIEGILKLYSSSFQYKSFKDPNLFAKEGEKKITNEDFELGYDEKIKK
IKDDFKSYKKALLEKKKNTLEDSLNSILSVYEQSLLTEQINNVKKWKEGLLKSKESIHK
QKKIENIEDIISRIEELKNVEGWIRTKERDIVNKEETNLKREIKKELKDSYYEEVRKDF
SDLKKGEESEKKPFREEPKPIVIKDYIKFDVLPGENSALGFFLSHLSFNLFDSIQYELF
EKSRLSSSKHPQIPETILDL (SEQ ID NO: 347)

>Cas14b.15|3300010293.a|Ga0116204_1008574|2134..4032
FRKFVKRSGAPQPDNLNKYKCIAIVRAANLDADIMSNESSNCVMCKGIKMNKRKTAKGA
AKTTELGRVYAGQSGNLLCTACTKSTMGPLVDYVPIGRIRAKYTILRAVKEYDFLSLAY
NLARTRVSKKGGRQKMHSLSELVIAAEYEIAWNIIKSSVIHYHQETKEEISGLRKKLQA
EHIHKNKEARIRREMHQISRRIKRLKWKWHMIPNSELHNFLFKQQDPSFVAVALLHTLG
RDIGMINKPKGSAKREFIPEYGFQIYYKWMNPKLNDINKQKYRKMPKRSLIPYKNLNVF
GDRELIENAMHKLLKLYDENLEVKGSKFFKTRVVAISSKESEKLKRDLLWKGELAKIKK
DFNADKNKMQELFKEVKEPKKANALMKQSRNMGFLLQNISYGALGLLANRMYEASAKQS
KGDATKQPSIVIPLEMEFGNAFPKLLLRSGKFAMNVSSPWLTIRKPKFVIKGNKIKNIT
KLMKDEKAKLKRLETSYHRATHFRPTLRGSIDWDSPYFSSPKQPNTHRRSPDRLSADIT
EYRGRLKSVEAELREGQRAMAKKLDSVDMTASNLQTSNFQLEKGEDPRLTEIDEKGRSI
RNCISSWKKFMEDLMKAQEANPVIKIKIALKDESSVLSEDSM (SEQ ID NO: 348)

FIG. 29 (Cont.)

>Cas14b.16|3300005573.a|Ga0078972_1001015a|33750..35627
KFHPENLNKSYCLAIVRAANLDADIQGHINCIGIKSNKSDRNYENKLESLQNVELLCKA
CTKSTYKPNINSVPVGEKKAKYSILSEIKKYDFNSLVYNLKKYRKGKSRGHQKLNELRE
LVITSEYKKALDVINKSVNHYLVNIKNKMSKLKKILQNEHIHVGTLARIRRERNRISRK
LDHYRKKWKFVPNKILKNYVFKNQSPDFVSVALLHKLGRDIGLITKTAILQKSFPEYSL
QLYYKYDTPKLNYLKKSKFKSLPKRILISYKYPKFDINSNYIEESIDKLLKLYEESPIY
KNNSKIIEFFKKSEDNLIKSENDSLKRGIMKEFEKVTKNFSSKKKKLKEELKLKNEDKN
SKMLAKVSRPIGFLKAYLSYMLFNIISNRIFEFSRKSSGRIPQLPSCIINLGNQFENFK
NELQDSNIGSKKNYKYFCNLLLKSSGFNISYEEEHLSIKTPNFFINGRKLKEITSEKKK
IRKENEQLIKQWKKLTFFKPSNLNGKKTSDKIRFKSPNNPDIERKSEDNIVENIAKVKY
KLEDLLSEQRKEFNKLAKKHDGVDVEAQCLQTKSFWIDSNSPIKKSLEKKNEKVSVKKK
MKAIRSCISAWKWFMADLIEAQKETPMIKLKLALM (SEQ ID NO: 349)

>Cas14c.1|CG10_big_fil_rev_8_21_14_0.10_scaffold_4477_curat
ed|19327..20880|revcom
TTLVPSHLAGIEVMDETTSRNEDMIQKETSRSNEDENYLGVKNKCGINVHKSGRGSSKH
EPNMPPEKSGEGQMPKQDSTEMQQRFDESVTGETQVSAGATASIKTDARANSGPRVGTA
RALIVKASNLDRDIKLGCKPCEYIRSELPMGKKNGCNHCEKSSDIASVPKVESGFRKAK
YELVRRFESFAADSISRHLGKEQARTRGKRGKKDKKEQMGKVNLDEIAILKNESLIEYT
ENQILDARSNRIKEWLRSLRLRLRTRNKGLKKSKSIRRQLITLRRDYRKWIKPNPYRPD
EDPNENSLRLHTKLGVDIGVQGGDNKRMNSDDYETSFSITWRDTATRKICFTKPKGLLP
RHMKFKLRGYPELILYNEELRIQDSQKFPLVDWERIPIFKLRGVSLGKKKVKALNRITE
APRLVVAKRIQVNIESKKKKVLTRYVYNDKSINGRLVKAEDSNKDPLLEFKKQAEEINS
DAKYYENQEIAKNYLWGCEGLHKNLLEEQTKNPYLAFKYGFLNIV (SEQ ID
NO:350)

>Cas14c.2|3300001245.a|JGI12048J13642_10201286|4257..5489|r
evcom
LDFKRTCSQELVLLPEIEGLKLSGTQGVTSLAKKLINKAANVDRDESYGCHHCIHTRTS
LSKPVKKDCNSCNQSTNHPAVPITLKGYKIAFYELWHRFTSWAVDSISKALHRNKVMGK
VNLDEYAVVDNSHIVCYAVRKCYEKRQRSVRLHKRAYRCRAKHYNKSQPKVGRIYKKSK
RRNARNLKKEAKRYFQPNEITNGSSDALFYKIGVDLGIAKGTPETEVKVDVSICFQVYY
GDARRVLRVRKMDELQSFHLDYTGKLKLKGIGNKDTFTIAKRNESLKWGSTKYEVSRAH
KKFKPFGKKGSVKRKCNDYFRSIASWSCEAASQRAQSNLKNAFPYQKALVKCYKNLDYK
GVKKNDMWYRLCSNRIFRYSRIAEDIAQYQSDKGKAKFEFVILAQSVAEYDISAIM
(SEQ ID NO: 351)

FIG. 29 (Cont.)

>Cas14d.1|RIFCSPHIGHO2_01_FULL_CPR_46_36_rifcsphigho2_01_sc
affold_646_curated|49808..51616|revcom
VFLTDDKRKTALRKIRSAFRKTAEIALVRAQEADSLDRQAKKLTIETVSFGAPGAKNAF
IGSLQGYNWNSHRANVPSSGSAKDVFRITELGLGIPQSAHEASIGKSFELVGNVVRYTA
NLLSKGYKKGAVNKGAKQQREIKGKEQLSFDLISNGPISGDKLINGQKDALAWWLIDKM
GFHIGLAMEPLSSPNTYGITLQAFWKRHTAPRRYSRGVIRQWQLPFGRQLAPLIHNFFR
KKGASIPIVLTNASKKLAGKGVLLEQTALVDPKKWWQVKEQVTGPLSNIWERSVPLVLY
TATFTHKHGAAHKRPLTLKVIRISSGSVFLLPLSKVTPGKLVRAWMPDINILRDGRPDE
AAYKGPDLIRARERSFPLAYTCVTQIADEWQKRALESNRDSITPLEAKLVTGSDLLQIH
STVQQAVEQGIGGRISSPIQELLAKDALQLVLQQLFMTVDLLRIQWQLKQEVADGNTSE
KAVGWAIRISNIHKDAYKTAIEPCTSALKQAWNPLSGFEERTFQLDASIVRKRSTAKTP
DDELVIVLRQQAAEMTVAVTQSVSKELMELAVRHSATLHLLVGEVASKQLSRSADKDRG
AMDHWKLLSQSM (SEQ ID NO: 352)

>Cas14d.2|rifcsphigho2_01_scaffold_10981_curated|5762..7246
|revcom
EDLLQKALNTATNVAAIERHSCISCLFTESEIDVKYKTPDKIGQNTAGCQSCTFRVGYS
GNSHTLPMGNRIALDKLRETIQRYAWHSLLFNVPPAPTSKRVRAISELRVAAGRERLFT
VITFVQTNILSKLQKRYAANWTPKSQERLSRLREEGQHILSLLESGSWQQKEVVREDQD
LIVCSALTKPGLSIGAFCRPKYLKPAKHALVLRLIFVEQWPGQIWGQSKRTRRMRRRKD
VERVYDISVQAWALKGKETRISECIDTMRRHQQAYIGVLPFLILSGSTVRGKGDCPILK
EITRMRYCPNNEGLIPLGIFYRGSANKLLRVVKGSSFTLPMWQNIETLPHPEPFSPEGW
TATGALYEKNLAYWSALNEAVDWYTGQILSSGLQYPNQNEFLARLQNVIDSIPRKWFRP
QGLKNLKPNGQEDIVPNEFVIPQNAIRAHHVIEWYHKTNDLVAKTLLGWGSQTTLNQTR
PQGDLRFTYTRYYFREKEVPEV (SEQ ID NO: 353)

>Cas14d.3|RIFCSPLOWO2_01_FULL_OD1_45_34b_rifcsplowo2_01_sca
ffold_3495_curated|25656..27605|revcom
VPKKKLMRELAKKAVFEAIFNDPIPGSFGCKRCTLIDGARVTDAIEKKQGAKRCAGCEP
CTFHTLYDSVKHALPAATGCDRTAIDTGLWEILTALRSYNWMSFRRNAVSDASQKQVWS
IEELAIWADKERALRVILSALTHTIGKLKNGFSRDGVWKGGKQLYENLAQKDLAKGLFA
NGEIFGKELVEADHDMLAWTIVPNHQFHIGLIRGNWKPAAVEASTAFDARWLTNGAPLR
DTRTHGHRGRRFNRTEKLTVLCIKRDGGVSEEFRQERDYELSVMLLQPKNKLKPEPKGE
LNSFEDLHDHWWFLKGDEATALVGLTSDPTVGDFIQLGLYIRNPIKAHGETKRRLLICF
EPPIKLPLRRAFPSEAFKTWEPTINVFRNGRRDTEAYYDIDRARVFEFPETRVSLEHLS
KQWEVLRLEPDRENTDPYEAQQNEGAELQVYSLLQEAAQKMAPKVVIDPFGQFPLELFS
TFVAQLFNAPLSDTKAKIGKPLDSGFVVESHLHLLEEDFAYRDFVRVTFMGTEPTFRVI
HYSNGEGYWKKTVLKGKNNIRTALIPEGAKAAVDAYKNKRCPLTLEAAILNEEKDRRLV
LGNKALSLLAQTARGNLTILEALAAEVLRPLSGTEGVVHLHACVTRHSTLTESTETDNM
(SEQ ID NO: 354)

FIG. 29 (Cont.)

>Cas14e.1|rifcsphigho2_01_scaffold_566_curated|113069..114313
VEKLFSERLKRAMWLKNEAGRAPPAETLTLKHKRVSGGHEKVKEELQRVLRSLSGTNQA
AWNLGLSGGREPKSSDALKGEKSRVVLETVVFHSGHNRVLYDVIEREDQVHQRSSIMHM
RRKGSNLLRLWGRSGKVRRKMREEVAEIKPVWHKDSRWLAIVEEGRQSVVGISSAGLAV
FAVQESQCTTAEPKPLEYVVSIWFRGSKALNPQDRYLEFKKLKTTEALRGQQYDPIPFS
LKRGAGCSLAIRGEGIKFGSRGPIKQFFGSDRSRPSHADYDGKRRLSLFSKYAGDLADL
TEEQWNRTVSAFAEDEVRRATLANIQDFLSISHEKYAERLKKRIESIEEPVSASKLEAY
LSAIFETFVQQREALASNFLMRLVESVALLISLEEKSPRVEFRVARYLAESKEGFNRKA
M (SEQ ID NO: 355)

>Cas14e.2|rifcsplowo2_01_scaffold_81231_curated|976..2217
VVITQSELYKERLLRVMEIKNDRGRKEPRESQGLVLRFTQVTGGQEKVKQKLWLIFEGF
SGTNQASWNFGQPAGGRKPNSGDALKGPKSRVTYETVVFHFGLRLLSAVIERHNLKQQR
QTMAYMKRRAAARKKWARSGKKCSRMRNEVEKIKPKWHKDPRWFDIVKEGEPSIVGISS
AGFAIYIVEEPNFPRQDPLEIEYAISIWFRRDRSQYLTFKKIQKAEKLKELQYNPIPFR
LKQEKTSLVFESGDIKFGSRGSIEHFRDEARGKPPKADMDNNRRLTMFSVFSGNLTNLT
EEQYARPVSGLLAPDEKRMPTLLKKLQDFFTPIHEKYGERIKQRLANSEASKRPFKKLE
EYLPAIYLEFRARREGLASNWVLVLINSVRTLVRIKSEDPYIEFKVSQYLLEKEDNKAL
(SEQ ID NO: 356)

>Cas14e.3|rifcsphigho2_01_scaffold_4702_curated|82881..84230|revcom
KQDALFEERLKKAIFIKRQADPLQREELSLLPPNRKIVTGGHESAKDTLKQILRAINGT
NQASWNPGTPSGKRDSKSADALAGPKSRVKLETVVFHVGHRLLKKVVEYQGHQKQQHGL
KAFMRTCAAMRKKWKRSGKVVGELREQLANIQPKWHYDSRPLNLCFEGKPSVVGLRSAG
IALYTIQKSVVPVKEPKPIEYAVSIWFRGPKAMDREDRCLEFKKLKIATELRKLQFEPI
VSTLTQGIKGFSLYIQGNSVKFGSRGPIKYFSNESVRQRPPKADPDGNKRLALFSKFSG
DLSDLTEEQWNRPILAFEGIIRRATLGNIQDYLTVGHEQFAISLEQLLSEKESVLQMSI
EQQRLKKNLGKKAENEWVESFGAEQARKKAQGIREYISGFFQEYCSQREQWAENWVQQL
NKSVRLFLTIQDSTPFIEFRVARYLPKGEKKKGKAM (SEQ ID NO: 357)

>Cas14f.1|rifcsp13_1_sub10_scaffold_3_curated|38906..41041
ANHAERHKRLRKEANRAANRNRPLVADCDTGDPLVGICRLLRRGDKMQPNKTGCRSCEQ
VEPELRDAILVSGPGRLDNYKYELFQRGRAMAVHRLLKRVPKLNRPKKAAGNDEKKAEN
KKSEIQKEKQKQRRMMPAVSMKQVSVADFKHVIENTVRHLFGDRRDREIAECAALRAAS
KYFLKSRRVRPRKLPKLANPDHGKELKGLRLREKRAKLKKEKEKQAELARSNQKGAVLH
VATLKKDAPPMPYEKTQGRNDYTTFVISAAIKVGATRGTKPLLTPQPREWQCSLYWRDG
QRWIRGGLLGLQAGIVLGPKLNRELLEAVLQRPIECRMSGCGNPLQVRGAAVDFFMTTN
PFYVSGAAYAQKKFKPFGTKRASEDGAAAKAREKLMTQLAKVLDKVVTQAAHSPLDGIW
ETRPEAKLRAMIMALEHEWIFLRPGPCHNAAEEVIKCDCTGGHAILWALIDEARGALEH
KEFYAVTRAHTHDCEKQKLGGRLAGFLDLLIAQDVPLDDAPAARKIKTLLEATPPAPCY
KAATSIATCDCEGKFDKLWAIIDATRAGHGTEDLWARTLAYPQNVNCKCKAGKDLTHRL
ADFLGLLIKRDGPFRERPPHKVTGDRKLVFSGDKKCKGHQYVILAKAHNEEVVRAWISR
WGLKSRTNKAGYAATELNLLLNWLSICRRRWMDMLTVQRDTPYIRMKTGRLVVDDKKER
KAM (SEQ ID NO: 358)

FIG. 29 (Cont.)

>Cas14f.2|3300009991.a|Ga0105042_100140|1624..3348
AKQREALRVALERGIVRASNRTYTLVTNCTKGGPLPEQCRMIERGKARAMKWEPKLVGC
GSCAAATVDLPAIEEYAQPGRLDVAKYKLTTQILAMATRRMMVRAAKLSRRKGQWPAKV
QEEKEEPPEPKKMLKAVEMRPVAIVDFNRVIQTTIEHLWAERANADEAELKALKAAAAY
FGPSLKIRARGPPKAAIGRELKKAHRKKAYAERKKARRKRAELARSQARGAAAHAAIRE
RDIPPMAYERTQGRNDVTTIPIAAAIKIAATRGARPLPAPKPMKWQCSLYWNEGQRWIR
GGMLTAQAYAHAANIHRPMRCEMWGVGNPLKVRAFEGRVADPDGAKGRKAEFRLQTNAF
YVSGAAYRNKKFKPFGTDRGGIGSARKKRERLMAQLAKILDKVVSQAAHSPLDDIWHTR
PAQKLRAMIKQLEHEWMFLRPQAPTVEGTKPDVDVAGNMQRQIKALMAPDLPPIEKGSP
AKRFTGDKRKKGERAVRVAEAHSDEVVTAWISRWGIQTRRNEGSYAAQELELLLNWLQI
CRRRWLDMTAAQRVSPYIRMKSGRMITDAADEGVAPIPLVENM (SEQ ID NO: 359)

>Cas14g.1|RBG_13_scaffold_1401_curated|15949..18180
KSISGRSIKHMACLKDMLKSEITEIEEKQKKESLRKWDYYSKFSDEILFRRNLNVSANH
DANACYGCNPCAFLKEVYGFRIERRNNERIISYRRGLAGCKSCVQSTGYPPIEFVRRKF
GADKAMEIVREVLHRRNWGALARNIGREKEADPILGELNELLLVDARPYFGNKSAANET
NLAFNVITRAAKKFRDEGMYDIHKQLDIHSEEGKVPKGRKSRLIRIERKHKAIHGLDPG
ETWRYPHCGKGEKYGVWLNRSRLIHIKGNEYRCLTAFGTTGRRMSLDVACSVLGHPLVK
KKRKKGKKTVDGTELWQIKKATETLPEDPIDCTFYLYAAKPTKDPFILKVGSLKAPRWK
KLHKDFFEYSDTEKTQGQEKGKRVVRRGKVPRILSLRPDAKFKVSIWDDPYNGKNKEGT
LLRMELSGLDGAKKPLILKRYGEPNTKPKNFVFWRPHITPHPLTFTPKHDFGDPNKKTK
RRRVFNREYYGHLNDLAKMEPNAKFFEDREVSNKKNPKAKNIRIQAKESLPNIVAKNGR
WAAFDPNDSLWKLYLHWRGRRKTIKGGISQEFQEFKERLDLYKKHEDESEWKEKEKLWE
NHEKEWKKTLEIHGSIAEVSQRCVMQSMMGPLDGLVQKKDYVHIGQSSLKAADDAWTFS
ANRYKKATGPKWGKISVSNLLYDANQANAELISQSISKYLSKQKDNQGCEGRKMKFLIK
IIEPLRENFVKHTRWLHEMTQKDCEVRAQFSRVSM (SEQ ID NO:360)

>Cas14g.2|3300009652.a|Ga0123330_1010394|2814..5123
FPSDVGADALKHVRMLQPRLTDEVRKVALTRAPSDRPALARFAAVAQDGLAFVRHLNVS
ANHDSNCTFPRDPRDPRRGPCEPNPCAFLREVWGFRIVARGNERALSYRRGLAGCKSCV
QSTGFPSVPFHRIGADDCMRKLHEILKARNWRLLARNIGREREADPLLTELSEYLLVDA
RTYPDGAAPNSGRLAENVIKRAAKKFRDEGMRDIHAQLRVHSREGKVPKGRLQRLRRIE
RKHRAIHALDPGPSWEAEGSARAEVQGVAVYRSQLLRVGHHTQQIEPVGIVARTLFGVG
RTDLDVAVSVLGAPLTKRKKGSKTLESTEDFRIAKARETRAEDKIEVAFVLYPTASLLR
DEIPKDAFPAMRIDRFLLKVGSVQADREILLQDDYYRFGDAEVKAGKNKGRTVTRPVKV
PRLQALRPDAKFRVNVWADPFGAGDSPGTLLRLEVSGVTRRSQPLRLLRYGQPSTQPAN
FLCWRPHRVPDPMTFTPRQKFGERRKNRRTRRPRVFERLYQVHIKHLAHLEPNRKWFEE
ARVSAQKWAKARAIRRKGAEDIPVVAPPAKRRWAALQPNAELWDLYAHDREARKRFRGG
RAAEGEEFKPRLNLYLAHEPEAEWESKRDRWERYEKKWTAVLEEHSRMCAVADRTLPQF
LSDPLGARMDDKDYAFVGKSALAVAEAFVEEGTVERAQGNCSITAKKKFASNASRKRLS
VANLLDVSDKADRALVFQAVRQYVQRQAENGGVEGRRMAFLRKLLAPLRQNFVCHTRWL
HM (SEQ ID NO: 361)

FIG. 29 (Cont.)

>Cas14h.1|3300005602.a|Ga0070762_10001740|7377..9071|revcom
AARKKKRGKIGITVKAKEKSPPAAGPFMARKLVNVAANVDGVEVHLCVECEADAHGSAS
ARLLGGCRSCTGSIGAEGRLMGSVDVDRERVIAEPVHTETERLGPDVKAFEAGTAESKY
AIQRGLEYWGVDLISRNRARTVRKMEEADRPESSTMEKTSWDEIAIKTYSQAYHASENH
LFWERQRRVRQHALALFRRARERNRGESPLQSTQRPAPLVLAALHAEAAAISGRARAEY
VLRGPSANVRAAAADIDAKPLGHYKTPSPKVARGFPVKRDLLRARHRIVGLSRAYFKPS
DVVRGTSDAIAHVAGRNIGVAGGKPKEIEKTFTLPFVAYWEDVDRVVHCSSFKADGPWV
RDQRIKIRGVSSAVGTFSLYGLDVAWSKPTSFYIRCSDIRKKFHPKGFGPMKHWRQWAK
ELDRLTEQRASCVVRALQDDEELLQTMERGQRYYDVFSCAATHATRGEADPSGGCSRCE
LVSCGVAHKVTKKAKGDTGIEAVAVAGCSLCESKLVGPSKPRVHRQMAALRQSHALNYL
RRLQREWEALEAVQAPTPYLRFKYARHLEVRSM (SEQ ID NO: 362)

>Cas14h.2|3300005921.a|Ga0070766_10011912|384..2081
AAKKKKQRGKIGISVKPKEGSAPPADGPFMARKLVNVAANVDGVEVNLCIECEADAHGS
APARLLGGCKSCTGSIGAEGRLMGSVDVDRADAIAKPVNTETEKLGPDVQAFEAGTAET
KYALQRGLEYWGVDLISRNRSRTVRRTEEGQPESATMEKTSWDEIAIKSYTRAYHASEN
HLFWERQRRVRQHALALFKRAKERNRGDSTLPREPGHGLVAIAALACEAYAVGGRNLAE
TVVRGPTFGTARAVRDVEIASLGRYKTPSPKVAHGSPVKRDFLRARHRIVGLARAYYRP
SDVVRGTSDAIAHVAGRNIGVAGGKPRAVEAVFTLPFVAYWEDVDRVVHCSSFQVSAPW
NRDQRMKIAGVTTAAGTFSLHGGELKWAKPTSFYIRCSDTRRKFRPKGFGPMKRWRQWA
KDLDRLVEQRASCVVRALQDDAALLETMERGQRYYDVFACAVTHATRGEADRLAGCSRC
ALTPCQEAHRVTTKPRGDAGVEQVQTSDCSLCEGKLVGPSKPRLHRTLTLLRQEHGLNY
LRRLQREWESLEAVQVPTPYLRFKYARHLEVRSM (SEQ ID NO: 363)

>Cas14h.3|3300009698.a|Ga0116216_10000905|8005..9504
TDSQSESVPEVVYALTGGEVPGRVPPDGGSAEGARNAPTGLRKQRGKIKISAKPSKPGS
PASSLARTLVNEAANVDGVQSSGCATCRMRANGSAPRALPIGCVACASSIGRAPQEETV
CALPTTQGPDVRLLEGGHALRKYDIQRALEYWGVDLIGRNLDRQAGRGMEPAEGATATM
KRVSMDELAVLDFGKSYYASEQHLFAARQRRVRQHAKALKIRAKHANRSGSVKRALDRS
RKQVTALAREFFKPSDVVRGDSDALAHVVGRNLGVSRHPAREIPQTFTLPLCAYWEDVD
RVISCSSLLAGEPFARDQEIRIEGVSSALGSLRLYRGAIEWHKPTSLYIRCSDTRRKFR
PRGGLKKRWRQWAKDLDRLVEQRACCIVRSLQADVELLQTMERAQRFYDVHDCAATHVG
PVAVRCSPCAGKQFDWDRYRLLAALRQEHALNYLRRLQREWESLEAQQVKMPYLRFKYA
RKLEVSGPLIGLEVRREPSMGTAIAEM (SEQ ID NO: 364)

>Cas14u.1|3300009029.a|Ga0066793_10010091|37..1113|revcom
AGTAGRRHGSLGARRSINIAGVTDRHGRWGCESCVYTRDQAGNRARCAPCDQSTYAPDV
QEVTIGQRQAKYTIFLTLQSFSWTNTMRNNKRAAAGRSKRTTGKRIGQLAEIKITGVGL
AHAHNVIQRSLQHNITKMWRAEKGKSKRVARLKKAKQLTKRRAYFRRRMSRQSRGNGFF
RTGKGGIHAVAPVKIGLDVGMIASGSSEPADEQTVTLDAIWKGRKKKIRLIGAKGELAV
AACRFREQQTKGDKCIPLILQDGEVRWNQNNWQCHPKKLVPLCGLEVSRKFVSQADRLA
QNKVASPLAARFDKTSVKGTLVESDFAAVLVNVTSIYQQCHAMLLRSQEPTPSLRVQRT
ITSM (SEQ ID NO: 365)

FIG. 29 (Cont.)

>Cas14u.2|3300002172.a|JGI24730J26740_1002785|496..1605|rev
com
GVRFSPAQSQVFFRTVIPQSVEARFAINMAAIHDAAGAFGCSVCRFEDRTPRNAKAVHG
CSPCTRSTNRPDVFVLPVGAIKAKYDVFMRLLGFNWTHLNRRQAKRVTVRDRIGQLDEL
AISMLTGKAKAVLKKSICHNVDKSFKAMRGSLKKLHRKASKTGKSQLRAKLSDLRERTN
TTQEGSHVEGDSDVALNKIGLDVGLVGKPDYPSEESVEVVVCLYFVGKVLILDAQGRIR
DMRAKQYDGFKIPIIQRGQLTVLSVKDLGKWSLVRQDYVLAGDLRFEPKISKDRKYAEC
VKRIALITLQASLGFKERIPYYVTKQVEIKNASHIAFVTEAIQNCAENFREMTEYLMKY
QEKSPDLKVLLTQLM (SEQ ID NO: 366)

>Cas14u.3|19ft_2_nophage_noknown_scaffold_0_curated|508188.
.509648
RAVVGKVFLEQARRALNLATNFGTNHRTGCNGCYVTPGKLSIPQDGEKNAAGCTSCLMK
ATASYVSYPKPLGEKVAKYSTLDALKGFPWYSLRLNLRPNYRGKPINGVQEVAPVSKFR
LAEEVIQAVQRYHFTELEQSFPGGRRRLRELRAFYTKEYRRAPEQRQHVVNGDRNIVVV
TVLHELGFSVGMFNEVELLPKTPIECAVNVFIRGNRVLLEVRKPQFDKERLLVESLWKK
DSRRHTAKWTPPNNEGRIFTAEGWKDFQLPLLLGSTSRSLRAIEKEGFVQLAPGRDPDY
NNTIDEQHSGRPFLPLYLYLQGTISQEYCVFAGTWVIPFQDGISPYSTKDTFQPDLKRK
AYSLLLDAVKHRLGNKVASGLQYGRFPAIEELKRLVRMHGATRKIPRGEKDLLKKGDPD
TPEWWLLEQYPEFWRLCDAAAKRVSQNVGLLLSLKKQPLWQRRWLESRTRNEPLDNLPL
SMALTLHLTNEEAL (SEQ ID NO: 367)

>Cas14u.4|rifcsp2_19_4_full_scaffold_168_curated|84455..856
57
AAVYSKFYIENHFKMGIPETLSRIRGPSIIQGFSVNENYINIAGVGDRDFIFGCKKCKY
TRGKPSSKKINKCHPCKRSTYPEPVIDVRGSISEFKYKIYNKLKQEPNQSIKQNTKGRM
NPSDHTSSNDGIIINGIDNRIAYNVIFSSYKHLMEKQINLLRDTTKRKARQIKKYNNSG
KKKHSLRSQTKGNLKNRYHMLGMFKKGSLTITNEGDFITAVRKVGLDISLYKNESLNKQ
EVETELCLNIKWGRTKSYTVSGYIPLPINIDWKLYLFEKETGLTLRLFGNKYKIQSKKF
LIAQLFKPKRPPCADPVVKKAQKWSALNAHVQQMAGLFSDSHLLKRELKNRMHKQLDFK
SLWVGTEDYIKWFEELSRSYVEGAEKSLEFFRQDYFCFNYTKQTTM (SEQ ID NO:
488)

>Cas14u.5|3300012532.a|Ga0137373_10000316|3286..5286
PQQQRDLMLMAANYDQDYGNGCGPCTVVASAAYRPDPQAQHGCKRHLRTLGASAVTHVG
LGDRTATITALHRLRGPAALAARARAAQAASAPMTPDTDAPDDRRRLEAIDADDVVLVG
AHRALWSAVRRWADDRRAALRRRLHSEREWLLKDQIRWAELYTLIEASGTPPQGRWRNT
LGALRGQSRWRRVLAPTMRATCAETHAELWDALAELVPEMAKDRRGLLRPPVEADALWR
APMIVEGWRGGHSVVVDAVAPPLDLPQPCAWTAVRLSGDPRQRWGLHLAVPPLGQVQPP
DPLKATLAVSMRHRGGVRVRTLQAMAVDADAPMQRHLQVPLTLQRGGGLQWGIHSRGVR
RREARSMASWEGPPIWTGLQLVNRWKGQGSALLAPDRPPDTPPYAPDAAVAPAQPDTKR
ARRTLKEACTVCRCAPGHMRQLQVTLTGDGTWRRFRLRAPQGAKRKAEVLKVATQHDER
IANYTAWYLKRPEHAAGCDTCDGDSRLDGACRGCRPLLVGDQCFRRYLDKIEADRDDGL
AQIKPKAQEAVAAMAAKRDARAQKVAARAAKLSEATGQRTAATRDASHEARAQKELEAV
ATEGTTVRHDAAAVSAFGSWVARKGDEYRHQVGVLANRLEHGLRLQELMAPDSVVADQQ
RASGHARVGYRYVLTAM (SEQ ID NO:489)

FIG. 29 (Cont.)

>Cas14u.6|3300006028.a|Ga0070717_10000077|54519..56201|revcom
AVAHPVGRGNAGSPGARGPEELPRQLVNRASNVTRPATYGCAPCRHVRLSIPKPVLTGC
RACEQTTHPAPKRAVRGGADAAKYDLAAFFAGWAADLEGRNRRRQVHAPLDPQPDPNHE
PAVTLQKIDLAEVSIEEFQRVLARSVKHRHDGRASREREKARAYAQVAKKRRNSHAHGA
RTRRAVRRQTRAVRRAHRMGANSGEILVASGAEDPVPEAIDHAAQLRRRIRACARDLEG
LRHLSRRYLKTLEKPCRRPRAPDLGRARCHALVESLQAAERELEELRRCDSPDTAMRRL
DAVLAAAASTDATFATGWTVVGMDLGVAPRGSAAPEVSPMEMAISVFWRKGSRRVIVSK
PIAGMPIRRHELIRLEGLGTLRLDGNHYTGAGVTKGRGLSEGTEPDFREKSPSTLGFTL
SDYRHESRWRPYGAKQGKTARQFFAAMSRELRALVEHQVLAPMGPPLLEAHERRFETLL
KGQDNKSIHAGGGGRYVWRGPPDSKKRPAADGDWFRFGRGHADHRGWANKRHELAANYL
QSAFRLWSTLAEAQEPTPYARYKYTRVTM (SEQ ID NO:490)

>Cas14u.7|3300001256.a|JGI12210J13797_10004690|5792..7006
WDFLTLQVYERHTSPEVCVAGNSTKCASGTRKSDHTHGVGVKLGAQEINVSANDDRDHE
VGCNICVISRVSLDIKGWRYGCESCVQSTPEWRSIVRFDRNHKEAKGECLSRFEYWGAQ
SIARSLKRNKLMGGVNLDELAIVQNENVVKTSLKHLFDKRKDRIQANLKAVKVRMRERR
KSGRQRKALRRQCRKLKRYLRSYDPSDIKEGNSCSAFTKLGLDIGISPNKPPKIEPKVE
VVFSLFYQGACDKIVTVSSPESPLPRSWKIKIDGIRALYVKSTKVKFGGRTFRAGQRNN
RRKVRPPNVKKGKRKGSRSQFFNKFAVGLDAVSQQLPIASVQGLWGRAETKKAQTICLK
QLESNKPLKESQRCLFLADNWVVRVCGFLRALSQRQGPTPYIRYRYRCNM (SEQ ID NO:491)

>Cas14u.8|3300005660.a|Ga0073904_10021651|765..1943
ARNVGQRNASRQSKRESAKARSRRVTGGHASVTQGVALINAAANADRDHTTGCEPCTWE
RVNLPLQEVIHGCDSCTKSSPFWRDIKVVNKGYREAKEEIMRIASGISADHLSRALSHN
KVMGRLNLDEVCILDFRTVLDTSLKHLTDSRSNGIKEHIRAVHRKIRMRRKSGKTARAL
RKQYFALRRQWKAGHKPNSIREGNSLTALRAVGFDVGVSEGTEPMPAPQTEVVLSVFYK
GSATRILRISSPHPIAKRSWKVKIAGIKALKLIRREHDFSFGRETYNASQRAEKRKFSP
HAARKDFFNSFAVQLDRLAQQLCVSSVENLWVTEPQQKLLTLAKDTAPYGIREGARFAD
TRARLAWNWVFRVCGFTRALHQEQEPTPYCRFTWRSKM (SEQ ID NO:492)

FIG. 30
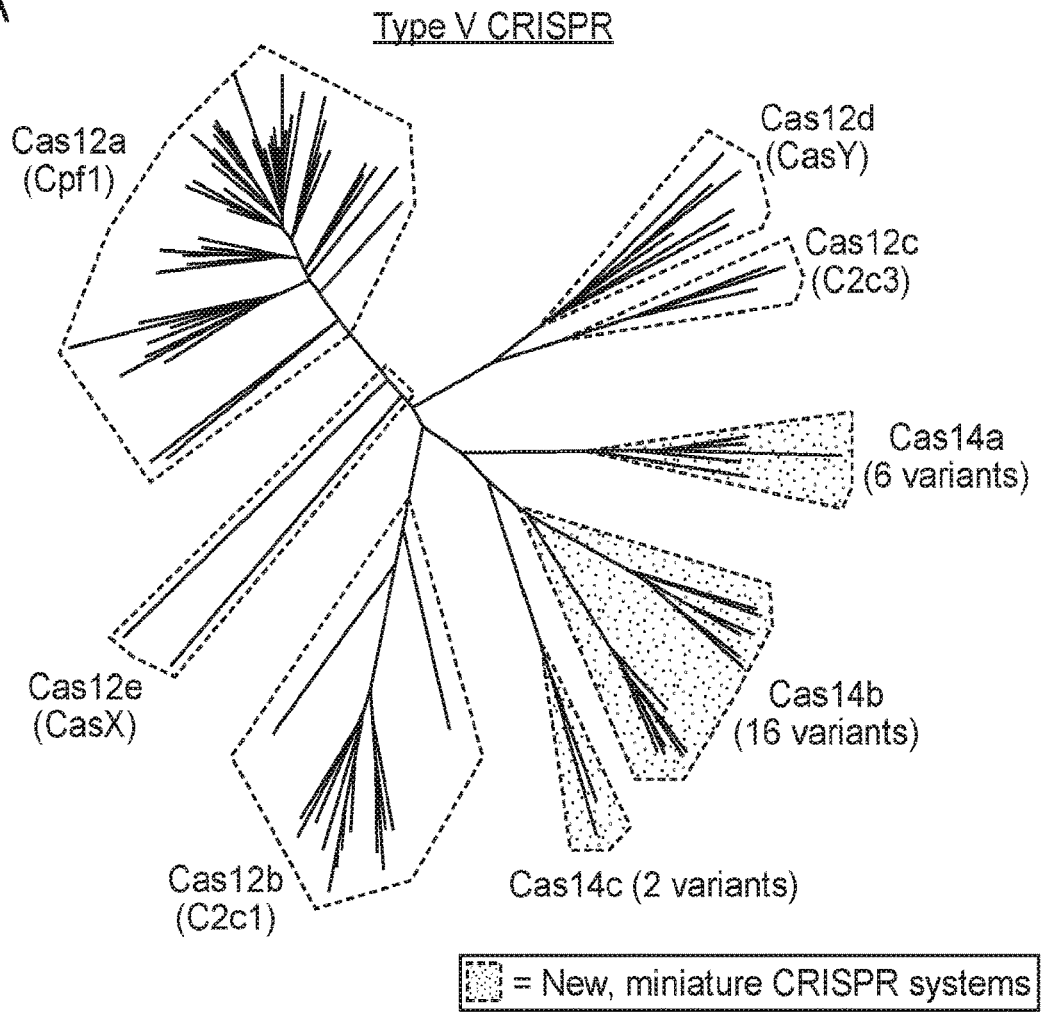
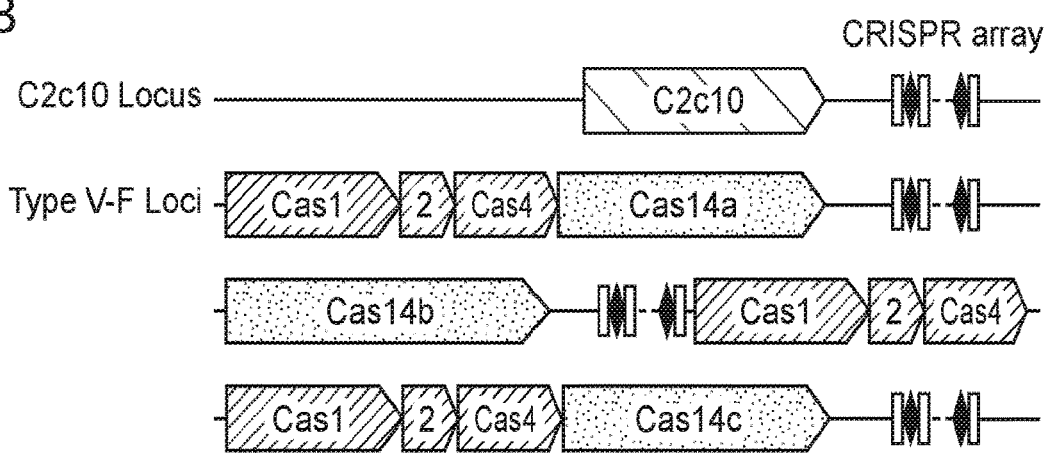

FIG. 30 (Cont.)
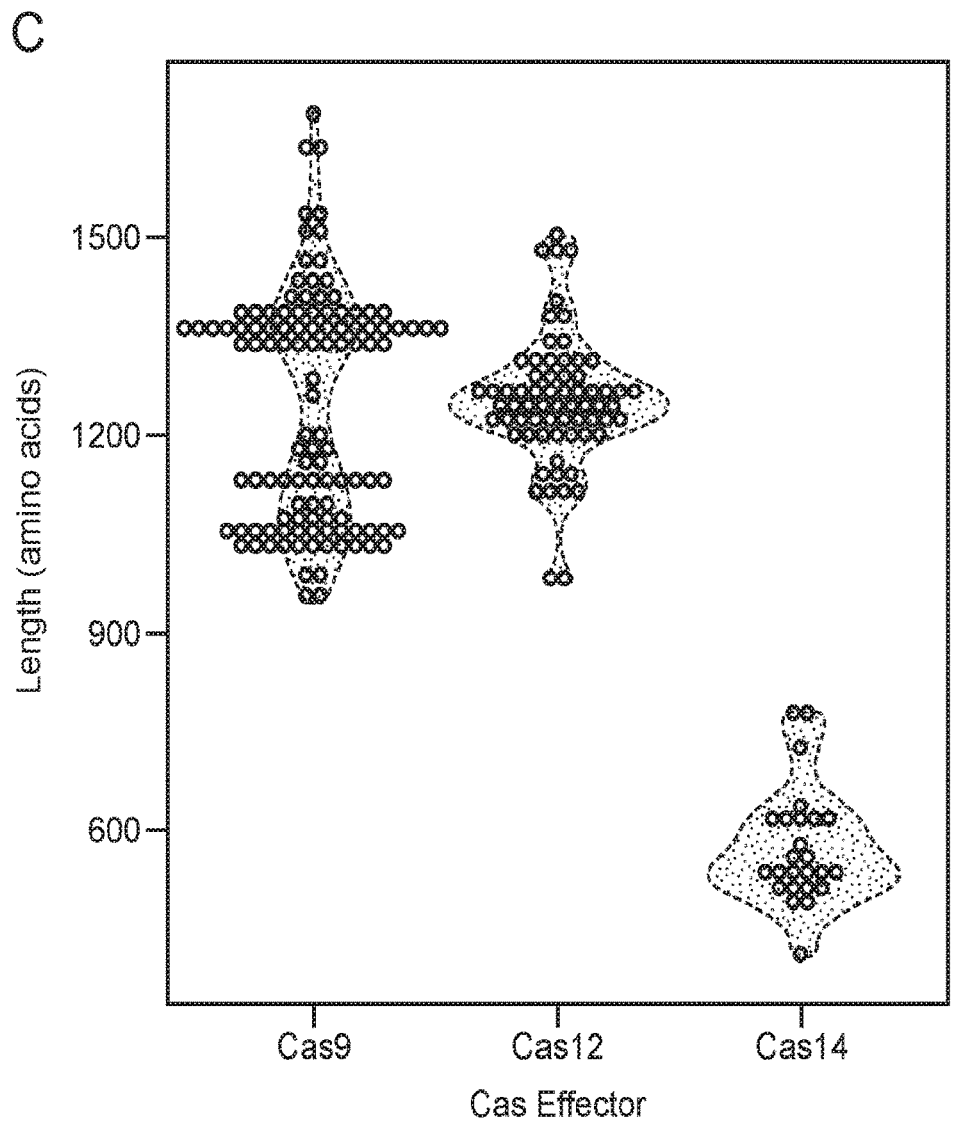
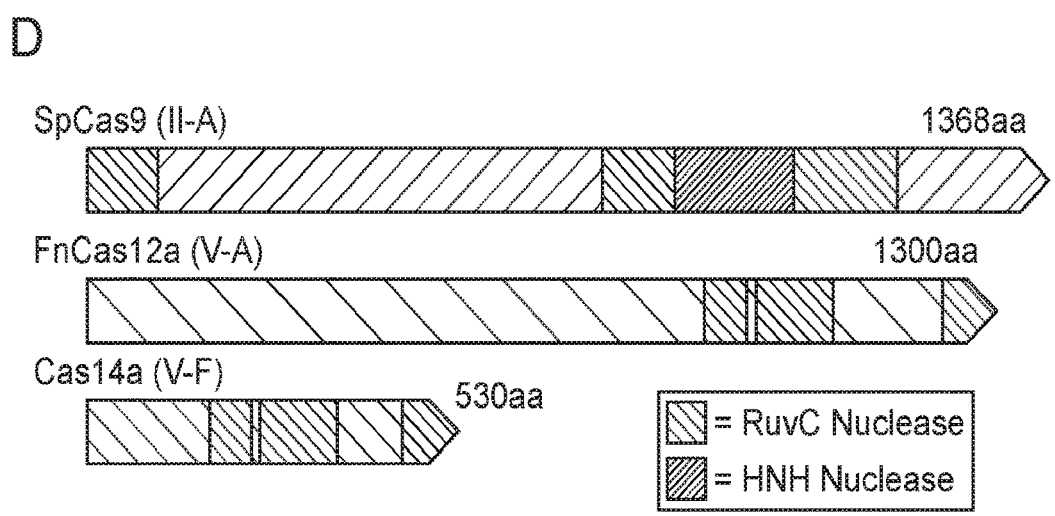

FIG. 33 (Cont.)
A (Cont.)
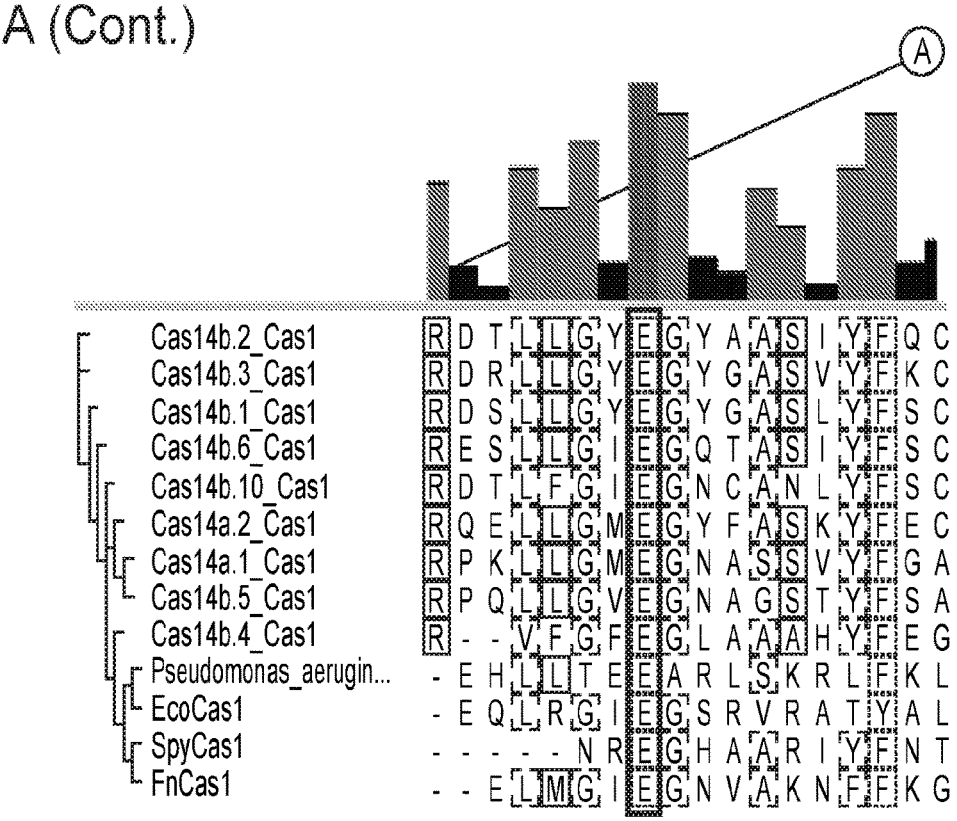
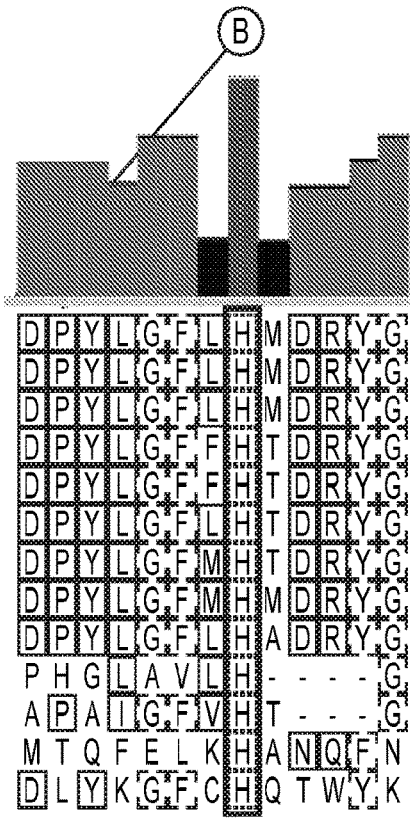
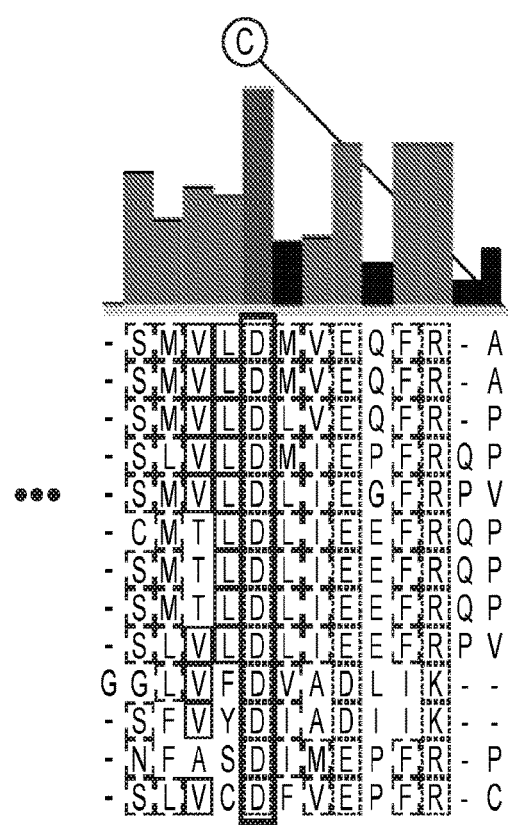

FIG. 34 (Cont.)
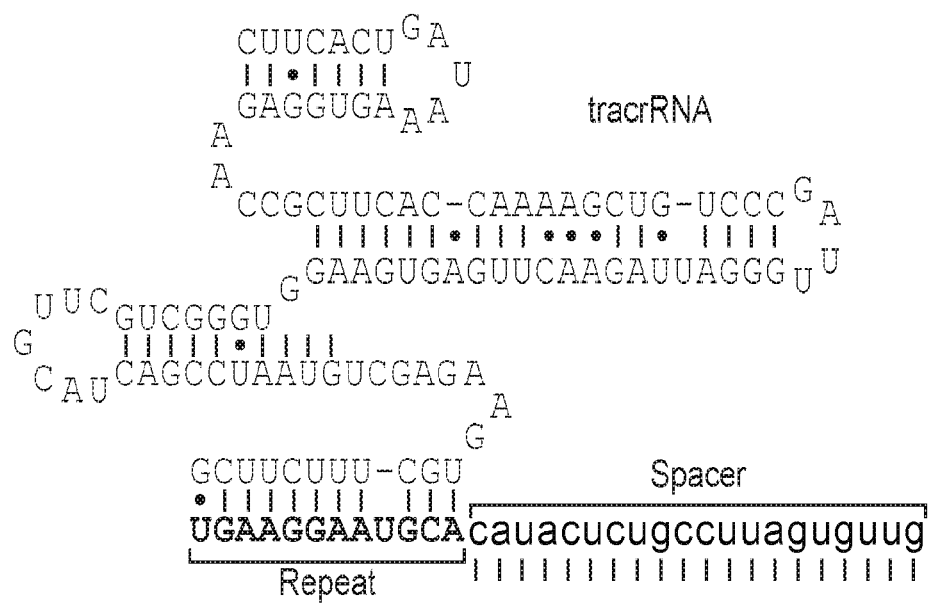
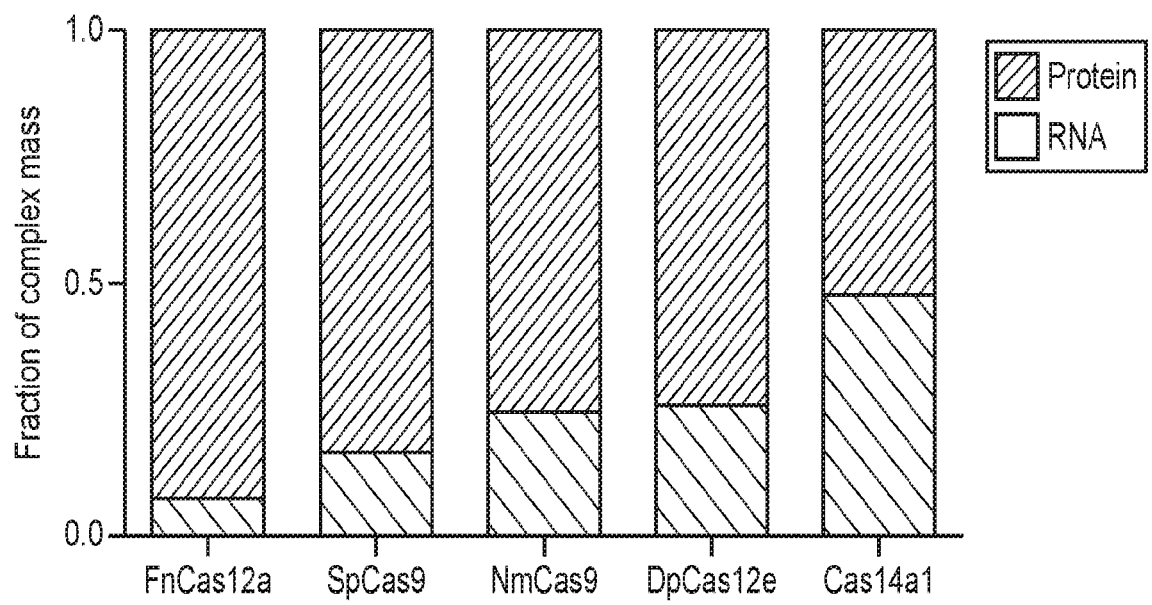

FIG. 35 (Cont.)

FIG. 36 (Cont.)
B
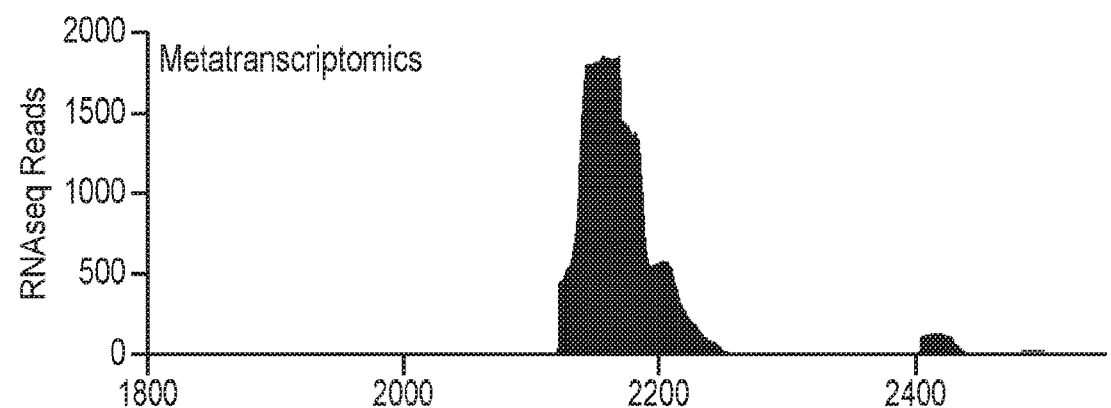
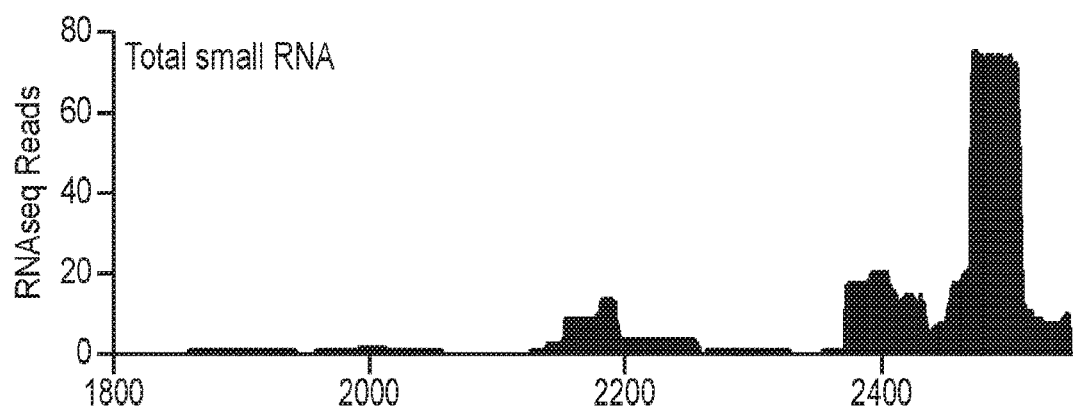
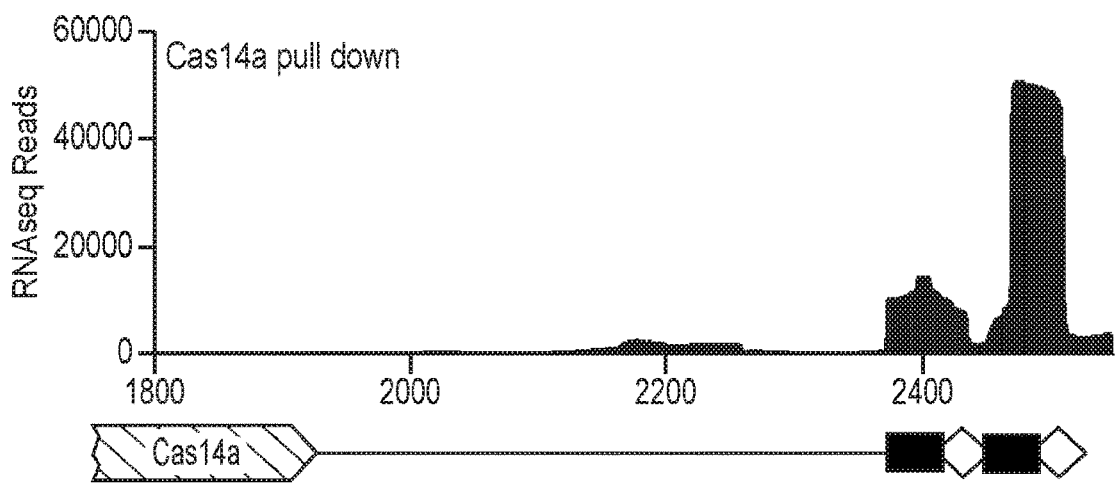

A

FIG. 37 (Cont.)
B
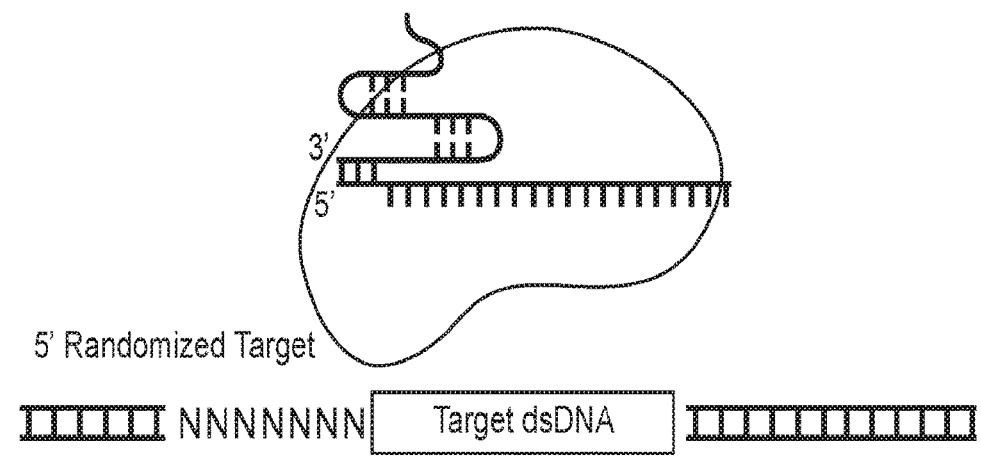
5' Randomized Target
PDVT
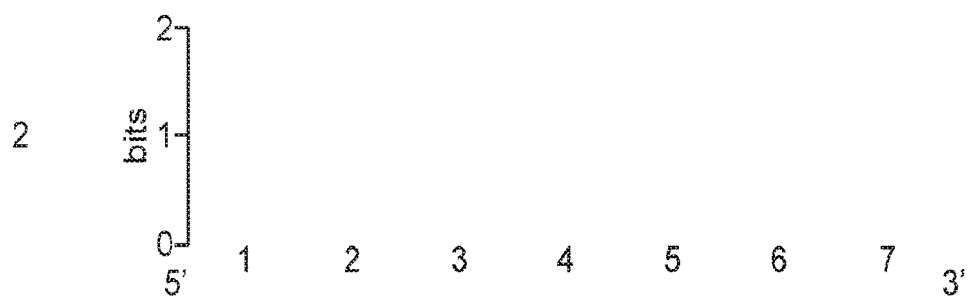
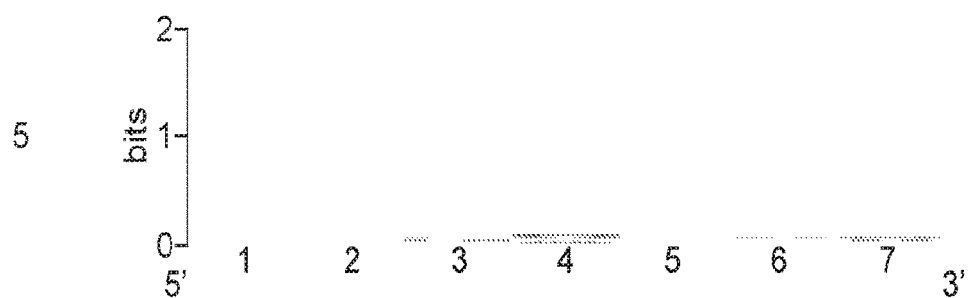

FIG. 37 (Cont.)
C
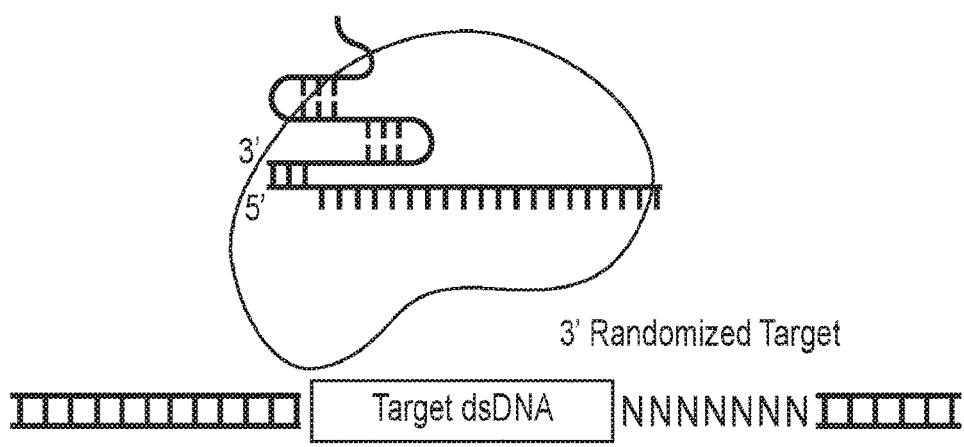
PDVT
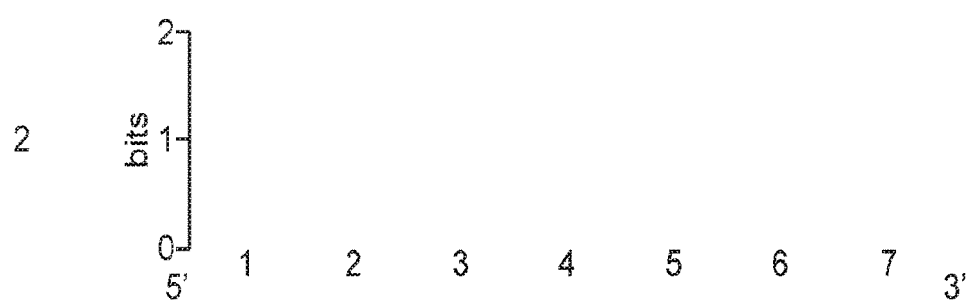
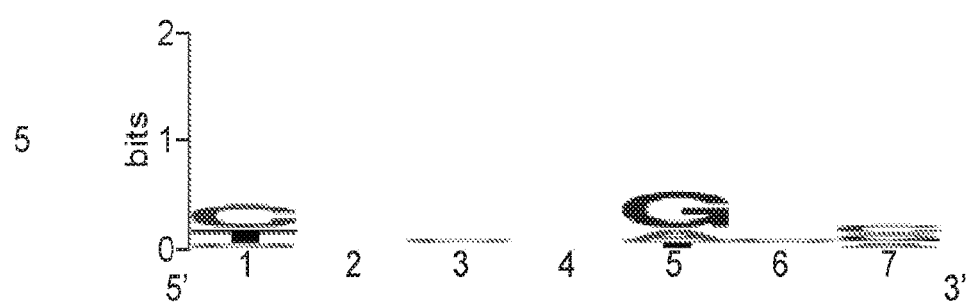

FIG. 38 (Cont.)
B
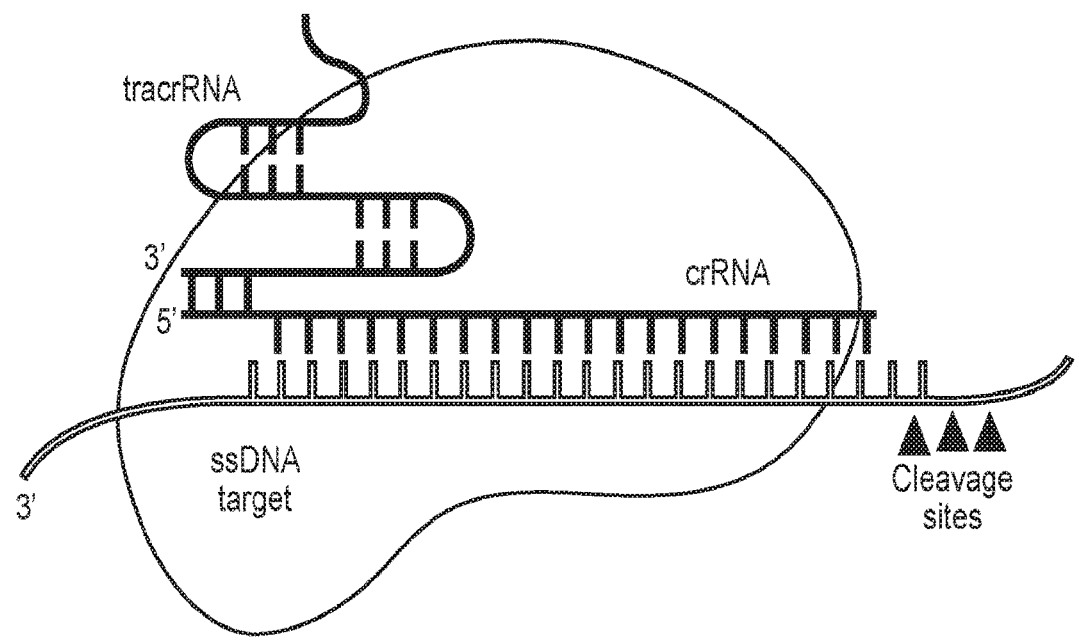
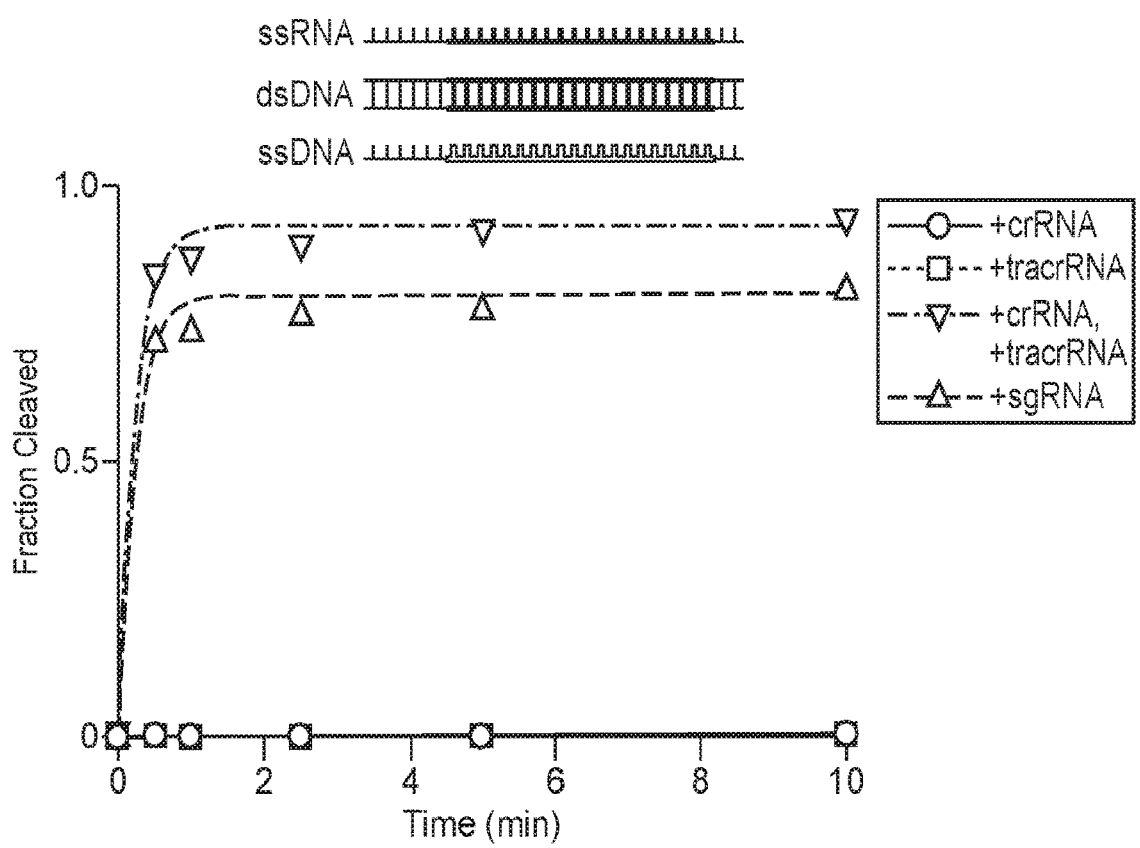

D (Cont.)

FIG. 41 (Cont.)
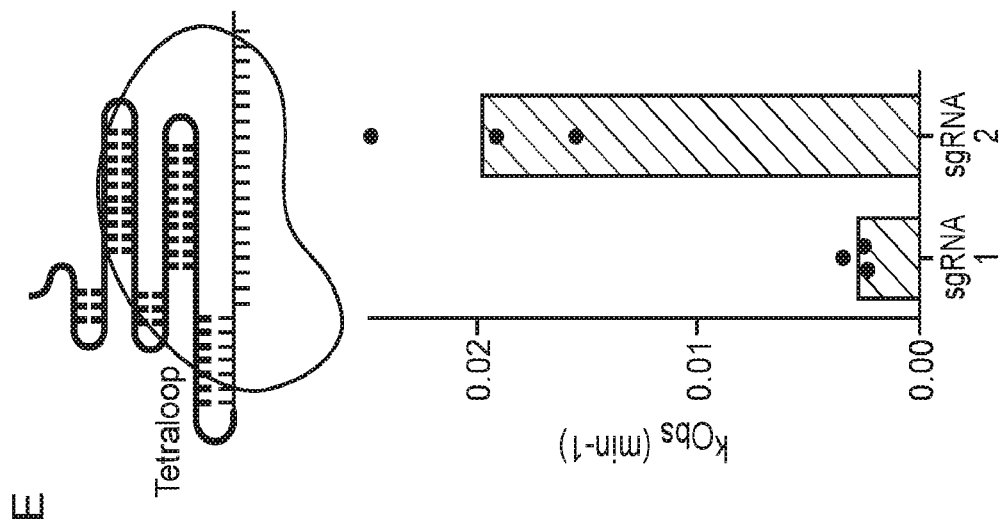
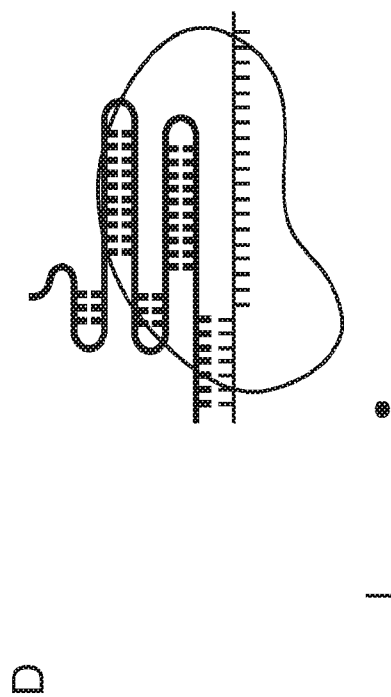
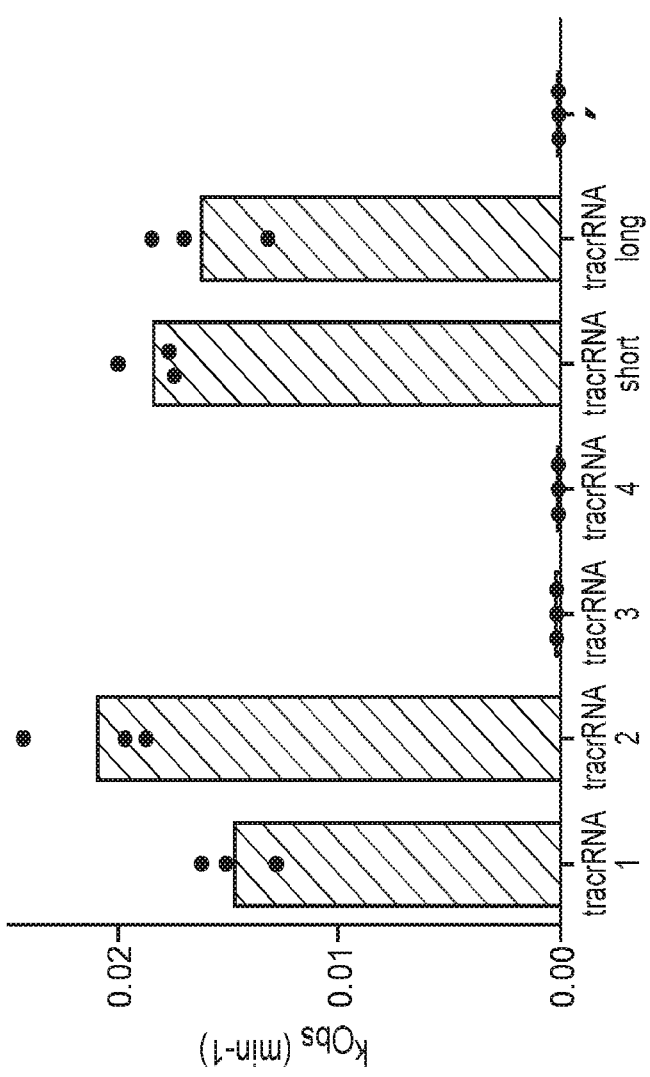

FIG. 41 (Cont.)
F
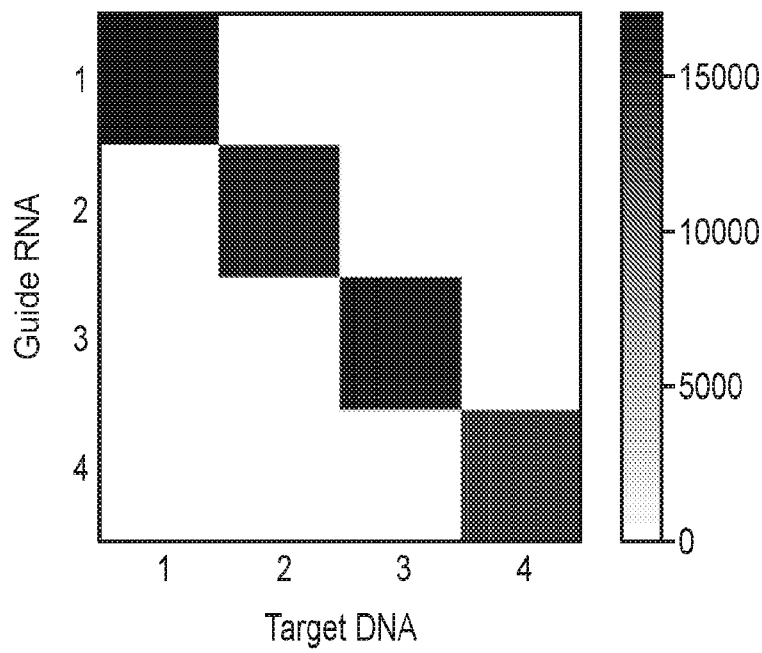
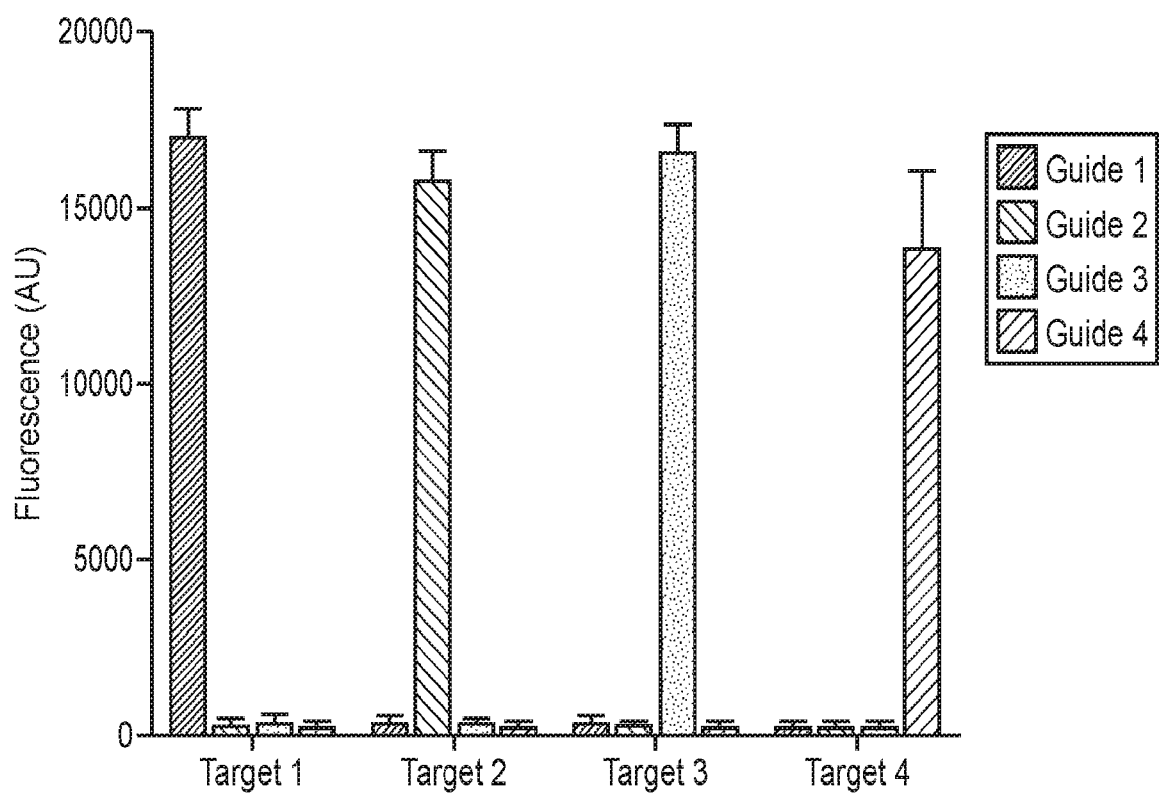

FIG. 42
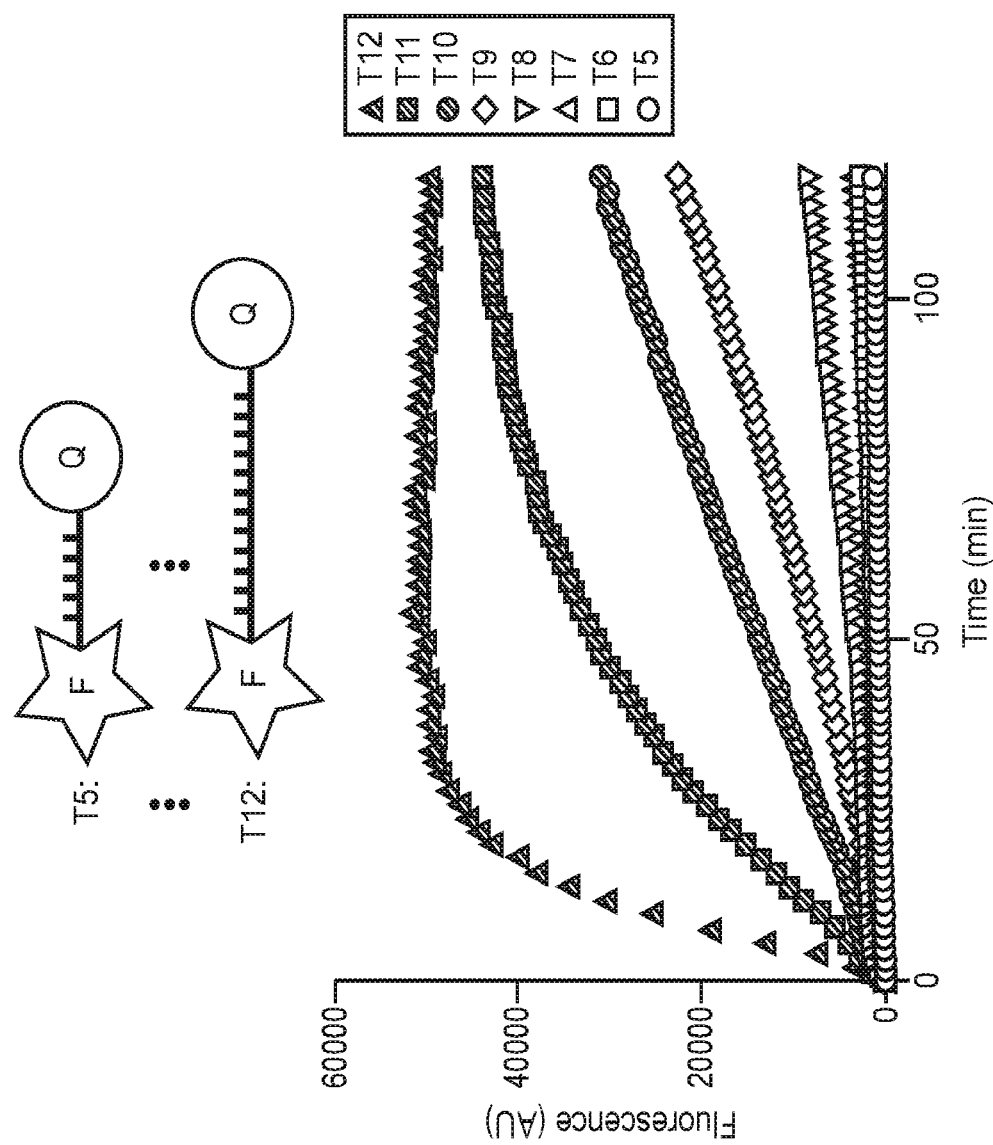
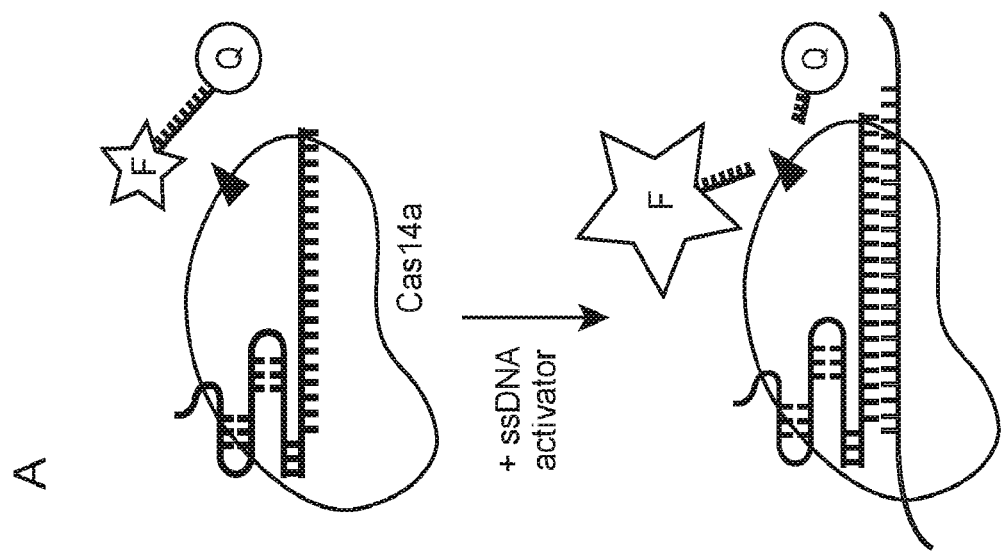

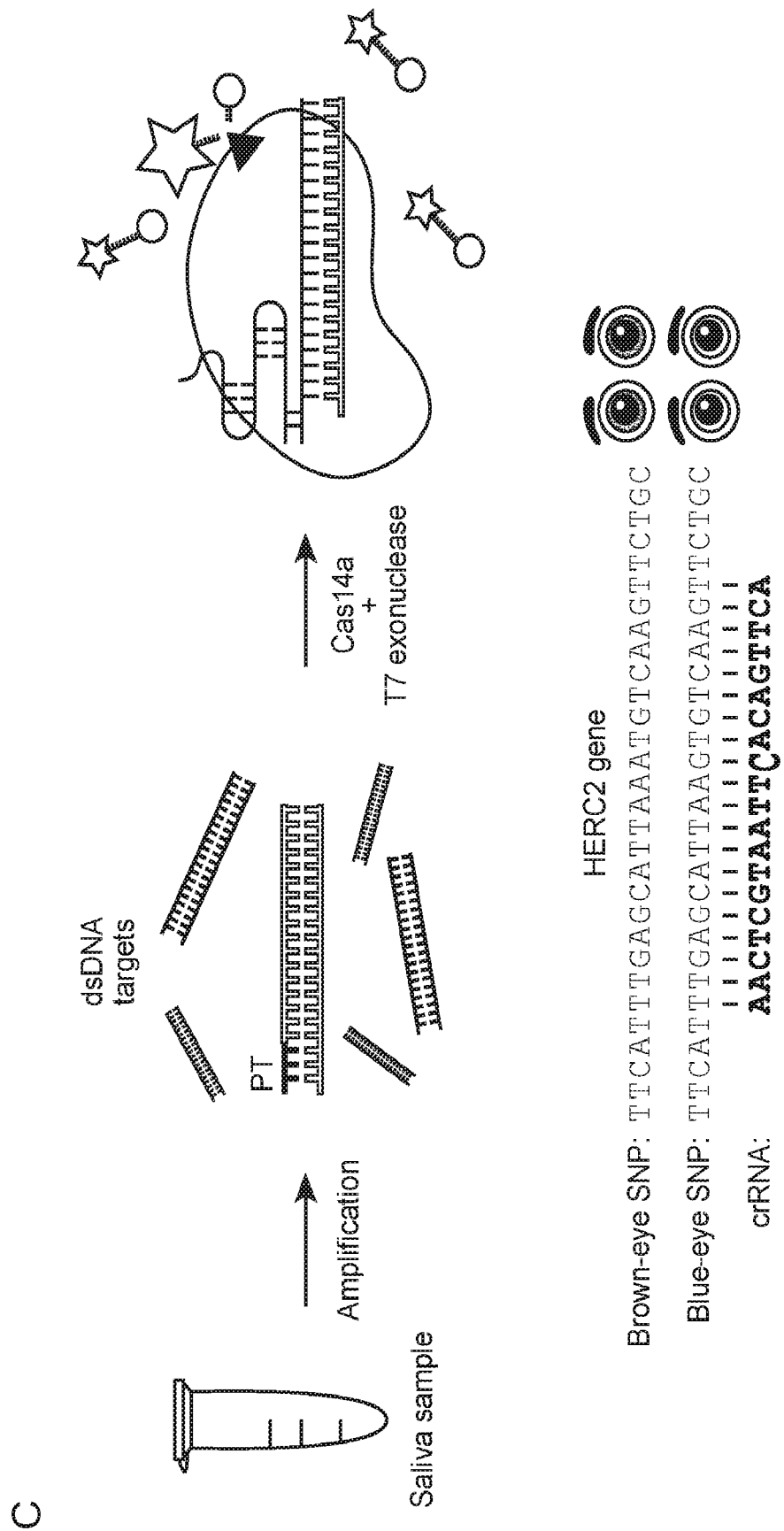

FIG. 43
A
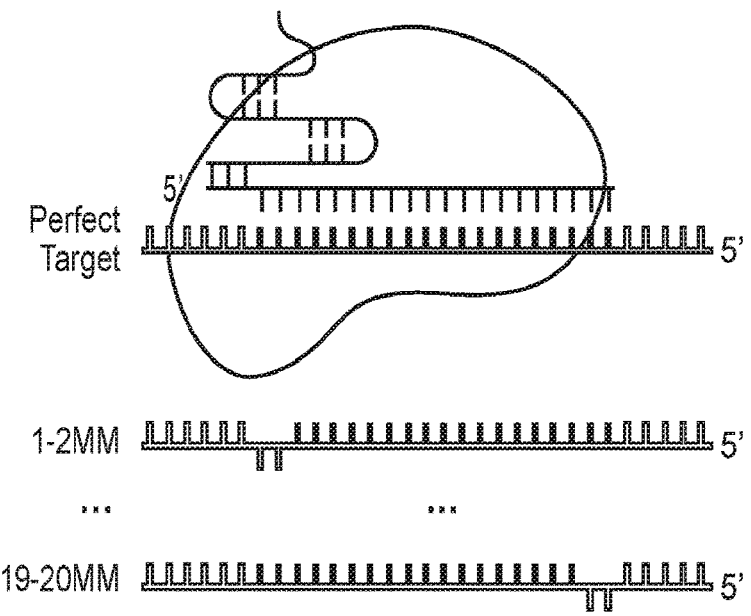
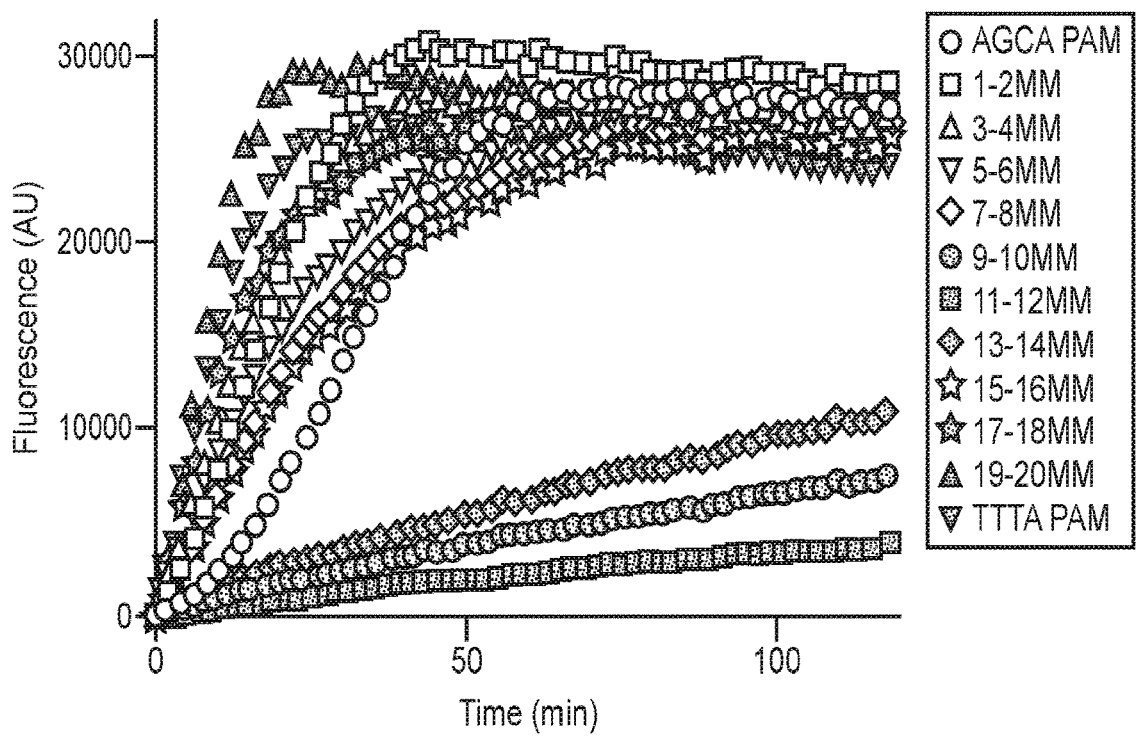

FIG. 43 (Cont.)
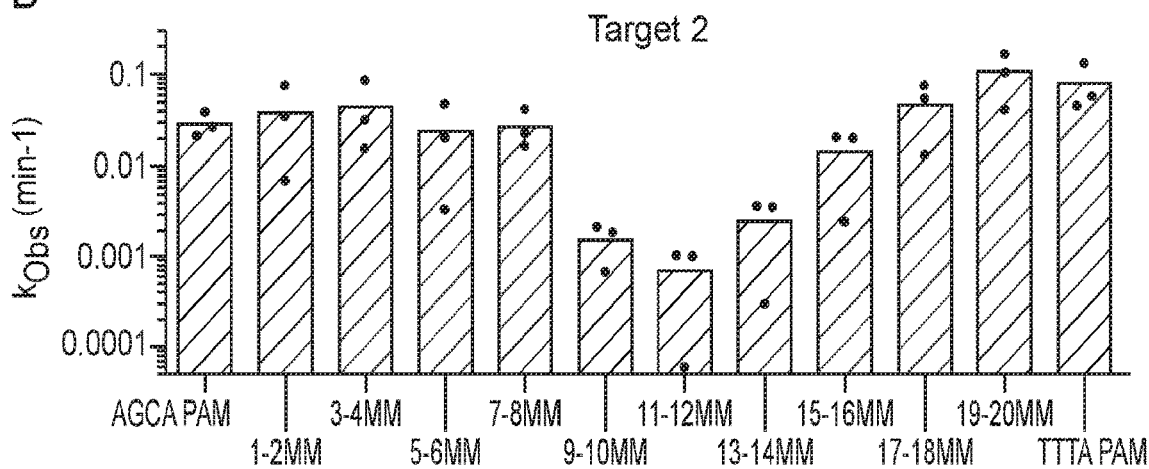
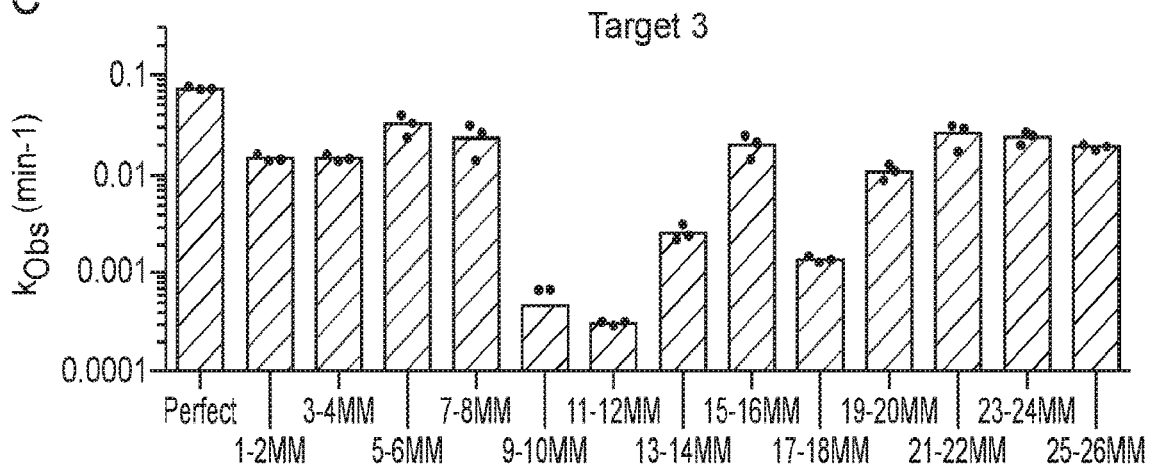
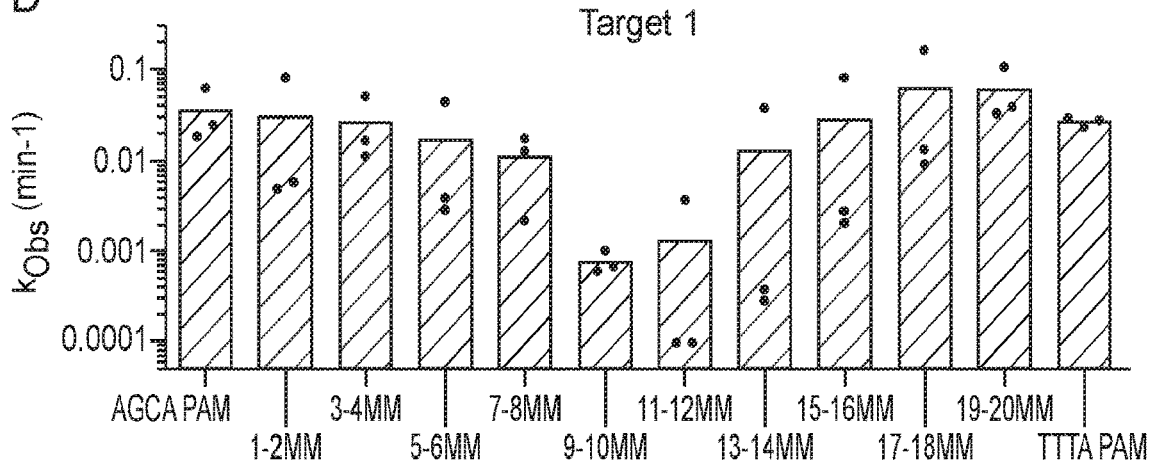

FIG. 45
A
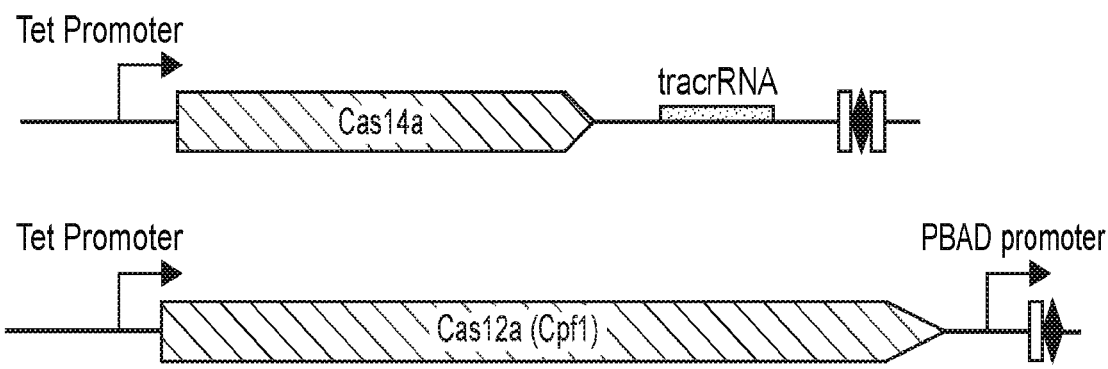
B
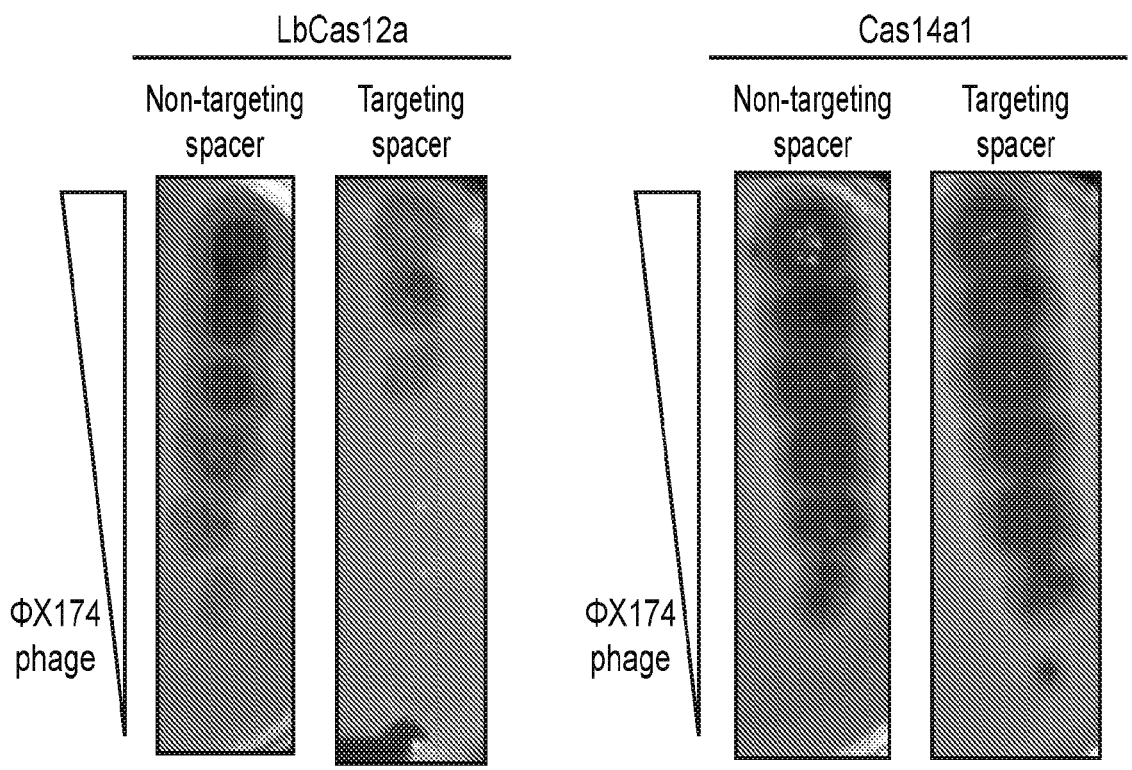

FIG. 46

Plasmid pLBH533_MBP-Cas14b2 expression (Addgene Plasmid Number 112506)

GCAACCGCACCTGTGGCGCCGGTGATGCCGGCCACGATGCGTCCGGCGTAGAGGATCGAGATCTCGATCC
CGGCGAAATTAATACGACTCACTATAGGGAGACCACAACGGTTTCCCTCTAGTGCCGGCTCCGGAGAGCTC
TTTAATTAAGCGGCCGCCCTGCAGGACTCGAGTTCTAGAAATAATTTGTTAACTTTAAGAAGGAGATA
TACATATGAAATCTTCTCACCATCACCATCACCATCACCATGGTTCTTCTATGAAAATCGAAGA
AGGTAAACTGGTAATCTGGATTAAAGTCACCGTTGAGCATCCGGATAAACGGGCTAAACGGTCTGAAGTCGGTAAGAAATTC
GAGAAAGATACCGGAATTAAAGTCACCGTTGAGCATCCGGATAAACGCGTTTGGTGCTACGCTCAATCTGG
CGGCAACTGGCGATGGCCCTGACATTATCTTCTGGCACACGACCGCGTTTGGTGCTACGCTCAATCTGG
CCTGTTGGCTGAAATCACCCCGGACAAAGCGCCTGACAAAGGCGTTATCCGTTACGTATCGGTATCCGTA
CGTTACAACGGCAAGCTGATTGCTTACCGGTGTTGAAGCGTTGATCGTTATCGCTGATTTATAACAAGATC
TGCTGCCGAACCGCCAAAAACTGGGAGGAGATCCGGCGCTGGATAAAGAACTGAAAGGCGAAAGGTAA
GAGCGCGGCTGATGTTCAACCTGCAAGAACCGTACTTCACCTGGCCGCTGATTGCTGCTGACGGGGTTAT
GCGTTCAAGTATGAAAACGGCAAGTACGACATTAAGACGGCGGTAAGACGTGGGCGTGGAATAACGCTGGGCGAAAGCGG
GTCTGACCTTCCGGTTGAACTGATTAAAGGCGAAACAGCGATGCCATCAAGCGCCGATCCAACATGACGACAC
AGCTGCCTTTAATAAGGCGATACTGCCGACCTCAAGGTCGCATCCAAACCGTTGTTGGCG
AGCAAAGTGAATTATGGTGTAACGGTCAGGTATTAACGCCGCCAGTCCGAACAAGAGCTGGCAAAGAGTTCCTCGAAACTATCT
TGCTGAGCGCAGGTATTAACGCCGCCAGTCCGAACAAAGAGCTGGCAAAGAGTTCCTCGAAACTATCT
GCTGACTGATGAAGGTCTGAAGCTGATGAAGATCCACGTATTGCCGGCGATATGCCGCCGCTATCAACGT
GAGGAAGAGTTGGCAGAAGATCCACGTATTGCCGGCGAAAGAGCCACTATGGAAACGCCCAGAAGGGAAATCATGC
CGAACATCCCGCAGATGTCCGGTTTCGTTCTGGTATGCCGGTACTGCGGTGATCAACGCCGCCAGCGGTCG
TCAGACTGTGAGGATGAAGCCCTGAAAGACGGCAGACTAATTCGAGCTGAACAACAACAATATTACCG
AACAACAAACTCGGGATCGAGGAAAAACCGTCACTTCCATCAAATGGAAGAAGCATTATGGATGAAT
GTGTGAAATTCAAACTGCCGCATCCGCATCGATAAAGAAAACCACCAAAAAACTGAACGAGTACTTCGATGAATATGG
CAAAGCAATTAACTTGCCCGTGAAGATCATCAGAAGAACTGGACAGATGCAGATATGCTTTTTGCAGTAAAGCA
AACTGGACCAGATAATAAACCGATCCTGATGAAACGGCAAAAAATCTATGAATTCCCGGATGAAT
TTTGCAGCTGTGTAAACAGGTTAACCAGGTTAACGACGTTAACAAACCGTTTGCCAAGAGTGCTATAAAT
CCGCTTTACCGGAAAATGTATTCGCAAACGTATGATGCCGCAAAGGTCGTAAAAGCCGAACATAAATC
AATATCCTGAACAGCACCAACAAGATCAGCAAAACCATTTTAACTATGCCATTCGCGAAGCCTTCATTC
TGGATAAAAGCATCAAAAGCGCAAAAAACGTAATGAACGTCTCGTGAAAGTAAAAACGTCTGCA
GCAGTTTATGTGATATGCCTGATCACCAAAAGATAAAAAGCTGGAAGATTTCCGGTTATACCCGTGAGTCGTCGT
TTTATTCATCCGAGCTGGAAGATCAACAAAGATAAAAAGCTGGAAGATTTCCGGGTTATACCCTGAGCATTA

FIG. 46 (Cont.)

TCAACAGCAAAATTAAGATTCTGGATCGCAACATCAAACGCGAAGAAAAAAGCCTGAAAGAAGAAAAAGGCCA
GATCATCTTTAAAGCCAAACGTCGATGCTGGATAAATCCATTCGTTTTGTTGGTGATCGCAAAGTGCTG
TTTACAATTAGTAAACCCTGCCGAAGAGTATGAACTGCCGAGCAAGAAAAACGGCTGAATT
GGCTGAAAGAGAAGATCGAGATTATCAAGAACCAGAAACGAAATATGCCTATCTGCTGGCAAAAACAT
TGAGAGCGAAAAAAAACGAACTATGAGTACTATCTGCAGTACACTGGAAATTAAACCGGAACTGAAA
GATTTTATGATGGTGCCATTGGTATTGACCGTGGCATTAATCATATTGCCGTTTGCACCTTTATTAGCA
ACGATGGTAAAGTTACCCCTCCGAAATTTTCAGCAGCGGTGAAATTCTGCGTCTGAAAAATCTGCAGAA
AGAGCGGTGATCGCTTTCTGCTGCGTAAACACAACAAAATCGCAAAAAGCAACATGCGCGTGATCGAA
AACAAAATCAATCTGATCCTGCACCGTTATAGCAAGCAGATTGTGATATGGCCAAAAAGCTGAATGCCA
GCATTGTTTTGAAGAACTGGGTCGTATTGGTAAACTGAGCGATCTTGGTTGATTACAAAGCCGTTATAA
ACTGAGCCTGTTCATCTTCAAGAAACTACCAGCAAGAATGTAGCCATTGCGGTGAAAAGTTAATACCAGC
GTTACCTATGTTCCGCTGAATATACCAGCAAGAATGTAGCCATTGCGGTGAAAAGTTAATACCAGC
GTCCGTTAATGCAACTATAGCCTGTTAATGCAACAAATGTGGCATCCAGCTGAACAGGATTATAA
TGCAAGCATCAACATTGCGAAAAAGGCCTGAAAATTCCGAATAGCACCTAATAACATTGGAAGTGGATA
ACGGATCCGGCGATCGGCGCCACCTGGCCGCCGGTACCCAGCGTGATCCGGCTGCT
AACAAAGCCCGAAAGGAAGCTGAGTTGGCTGCTGCCACCGCTGAGCAATAACTAGCATAACCCCTTGGG
CCTCTAAACGGGGTCTGAGGGTTTTTGCTGAAAGAGAACTATATCCGGATATCCACAGGACGGGTG
TGGTCGCCATGCATTGCGATAGTAGTGGCTCCAAGTAGCGAAGTAGCGCATATAGGCGTAGCAGCACG
GCGGTGGACAGTGCTCCGAGAACGGGTGCCGATGAAATTGCATCAACGCATATAGGCGTAGCAGCACG
CCATAGTGACTGGCGATGTCTGCGAATGGACGATATCCGCAAGACGATGAGCGCATTGTTAGATTCATACA
AGCCTATGCCTACACAGCATCCAGGGTGCACGGTGCCGAGGATGACGGTGCCATTGTTAGATTCATACA
CGGTGCCTGACTGCGTTAGCAATTAACTGTGATAAACTACCGCATTAAAGCTATCGATGATAAGCTGT
CAAACATAGAATTCTTGAAGACGAAAGGGCTCGTATACGCCTGTGATAGCGTAAAAGCTTTATATGGTTAATGTCATGATA
ATAATGGTTCTTAGACGTCAGGTGGCACTTTCGGGAAATGTGCGGGAACCCCTATTTGTTTATTT
TCTAAATACATTCAAATATGAGTATTCAACATTTCCGTGTCGCCCTTATTCCCTTTTTGGCATTTGCCTTCCT
AAGGAAGATATGAGTATTCAACATTTCCGTGTCGCCCTTATTCCCTTTTTGGCATTTGCCTTCCT
GTTTTTGCTCACCCAGAAACGCTGGTGAAAGTAAAAGATGCTGAAGATCAGTTGGGTGCACGAGTGGGTT
ACATCGAACTGGATCTCAACAGCGGTAAGATCCTTGAGAGTTTTCGCCCCGAAGAACGTTTTCCAATGAT
GAGCACTTTTAAAGTTCTGCTATGTGGCGCGGTATTATCCCGTGTTGACGCCGGGCAAGAGCAACTCGGT
CGCCGCATACACTATTCTCAGAATGACTTGGTTGAGTACTCACCAGTCACAGAAAAGCATCTTACGGATG
GCATGACAGTAAGAGAATTATGCAGTGCTGCCATAACCATGAGTGATAACACTGCGGCCAACTTACTTCT
GACAACGATCGGAGGACCGAAGGAGCTAACCGCTTTTTGCACAACATGGGGGATCATGTAACTGTAACTCGCCTT

TGCCCGAGATGGCGGCCGGTGCGGCTGCTGAGATGGCGGACGCGATGGATATGTTCTGCCAAGGGTTGGT
TGCGCATTCACAGTTCTCCGCAAGAATTGATTGGCTCCAATTCTTGGAGTGGTGAATCCGTTAGCGAGG
TGCCGCGGCTTCCATTCAGGTCGAGGTGGCCCGGCTCCAGCCGACGCAACGCGGGAGGCAGACAGAC
AAGTATAGGGGCGGCCTACAATCCATGCCAACCCGTTCCATGTCTGCCGAGGCGGCATAAATCGCC
GTGACGATCAGCGGTCAGCGGTCCAATGATCGAAGTTAGGCTGTAAGAGCCGGAGCGATCCTTGAAGCTGTCCT
GATGGTCGTCATCTACCTGCCTGGACAGCATGGCCATGGCCCTGCAACGCGGGCATCCCGATGCGCCGGAAGCGAG
AAGAATCATAATGGGGAAGGCATCCAGCCTCGCGTCCGAACGCCAGCAAGACGTAGCCAGCGCGTCG
GCGCCATGCCGGATAATGGCCTGCTTCTCGCCGAAACGTTGGTGGCGGACCAGTGACGAAGGCTT
GAGCGAGGGCGTGCAAGATTCCGAATACCGCAAGCGACAGGCCGATCATCGTCGCGCTCCAGCGAAAGCG
GTCCTCGCCGAAAATGACCCAGAGAGCGCTGCCGGCACCTGTCTACGAGTTGCATGATAAAGAAGACAGTC
ATAAGTGCGGCGACGATAGTCATGCCCCGACGAAGGAGCTGACTGGTTGAAGGCTCTCAAGG
GCATCGGTCGGCTCGAGCTCCTGCATTAGGAAGCAGCCAGTAGTAGGTTGAGGCGTT
GAGCACCGCCGCGCAAGGAATGGTGCATGCAAGGAGATGCGCCCAACAGTCCCCGGCCACGGGCCT
GCCACCATACCCACGCCGAAACAAGCGCTCATGAGCCCGAAGTGGCGAGCCCGATCTTCCCCATCGGTGA
TGTCGGCGATATAGGGGCCA (SEQ ID NO: 493)

FIG. 46 (Cont.)

Plasmid pLBH547_Tet-Cas14b2Locus (AddGene Plasmid Number: 112504)

AGTAGGTGTTCCCTTCTTCTTAGCGACTTGATGCTCTTGATCTTCCAATACGCAACCTAAAGTAAAA
TGCCCCACAGCGCTGAGTGCATATAATGCATTCTAGTGAAAACCTTGTTGGCATAAAAGGCTAATT
GATTTCGAGAGTTTCATACTGTTTTCTGTAGGCCGTGTACCTAAATGTACTTTGCTCCATGCGATG
ACTTAGTAAAGCACATCTAAAACTTTAGCGTTATTACGTAAAAAATCTGCCAGCTTTCCCTTCTAAA
GGGCAAAAGTGAGTATGGTGCTATCTAACATCTCAATGGCTAAGGCGTCGAGCAAGCCCGCTTATTTT
TTACATGCCAATACAAATGTAGGCTGCTCTACACCTAGCTTCTGGGCGAGTTTACGGGTTGTTAACCTTC
GATTCCGACCTCATTAAGCAGCTCTAATGCGCTGTTAATCACTTTACTTTTATCTAATCTAGACATCATT
AATTCCTAATTTTGTTGACACTCT (SEQ ID NO: 494)

FIG. 46 (Cont.)

Plasmid pLBH559_Tet-HisCas14a1Locus (AddGene Plasmid Number: 112502)

TAATTCCTAATTTTTGTTGACACTCTATCGTTGATAGAGTTATTTTACCACTCCTATCAGTGATAGAGA
AAGAATTCAAAGATCTAAAGAGGAGAAGGATCTATGAAATCTCACCATCACCATCACCATGAAACC
TGTACTTCCAATCCAATATTGGAAGTGGAATGGCCAAAAACACCATTACCAAAACACTGAAACTGCGTAT
TGTGCGTCCGTATAATAGCGCAGAAGTGGAAAAAATTGTTGCCGACGAAAAACAACCGGAAAAATC
GCACTGGAAAAGAACAAGACAAGTGAAAGAAAGTGCTGCAGCAAACATCTGAAAGTTGCAGCATATTGTA
CCACACAGGTGAACGTAATGCATGCCTGTTTTGTAAAGCACGTAAACTGATGACAAATTCTACCAAAA
ACTGGGTGGTCAGTTTCCGGATGCAGTTTTTGGCAAGAAATCAGCGAAATTTTCGCCAGCTGCAGAAA
CAGGCAGCAGAAATCTATAATCAGAGCCTGATCGAACCTGTACTACGAGATTTTTATCAAAGGCAAAGGTA
TTGCAAATGCCAGCAGCGTTGCCGACCACGGTTGAACATTATCTGAGTGATGTTTGTTATACCGTGCAGCAGAACTGTTTAA
AACGCAGCAATTGCAAGCGGTCTGCGTAGCAAATCAAAAGCAATTTCGTCTGAAAGAACTGAAAAC
ATGAAAAGTGGTCTGCCGACCACCAAAGCGATAATTTCCGATTCCGCTGGTAAACAGAAGGTGGTC
AGTATACCGGTTTGAAATTAGCAATCATAATAGCGACTTCATCATCAAGATTCCGTTTGGTCGTTGGCA
GGTCAAAAAGAGATTGATAAATATCGTCCGTGGGAGAAATTGACTTGAACAGGTTCAGAAAAGCCCG
AAACCGATTAGCCTGCTGAGCACCAGCGTCGTAAACGTGGGATTATCAGACCAGCTACATTGGAGCAAAGATGAAGGCA
CCGAAGCGAAATCAAAAAGTTATGAAAGTTATGAAGGCGATTATCGACCAGTATCGAGCATTGATGTTCCGAAATTAAACGTGGCAG
CAAAATCGGTGAAAAAAGCGCATGGTCTGAATGCTGAATCGAGCATTATGATGTTCCGAAATTGATAAAGGTGTG
GATCCGAGCATTATTGGTGTTATTGATGTGGTGTTAAATCACCGCTGGTTTGCCAATTACAATGCAT
TTAGCCGTTATAGCGATCAGCGATAACGACCTGTTTCACTTCAACAAGAAAAATGTTGCACGTGTCGTAT
CCTGCTGAAAAACCGTCATAACCGTCAGTCAGTGTGCAAAAACAACTGAAACCGATCACCATT
CTGACCGAAAAAGTGAACGTTTCGCAAAAAGCTCATGATTGAACGTGGGCATGTGAAATCGCGGATTCT
TCATTAAAAACAAGGTTGGCACCGTGCAGATGGAAAATCTGGAAAGCATGAAACGTAAAGAGGACAGCTA
TTTTAACATTCGCCTGCGTGCCTGGCTTTTGGCCGTATGCCGTATGCCAGAACAAATCGAATTCAAACTGAAG
CAGTATGGCATCGAAAATCGTAAAGTTGCACCGAAGAAACCTGTAGCAAACCTGTTAGCAAATGTGCCATC
TGAACAACTATTTCAAGTTCGAGTACCGCAGAAGAACCCTGAATATTCAAACCGAAACTGAAATGCAAAATGCAA
CTTCAAGAAAGCGCGATTATAATGCAGCCCTGAATATTCAAACCGAAACTGAAAGCACCAAAGAG
GAACCGTAAATATTTATACTTATTATCCTTCATTGACAAAAATGAGAATGTTATCCCAGTAACATTTG
ATGTACACAGATTCACACTTCACTGATAAAGTGGAGAACCGCTTCACCAAAAGCTGTCCCTTAGGATT
AGAACTTGAGTGAAGGTGGGCTGCTTGCATCAGCTAATGTGGAGAAGTGCTTCTCGAAAGTAACC
TCGAACAAATTCATTTTCCTCTCCAATTCTGCACAAAAAGGTGAGTCCTTATAAACCGGTGCAG

FIG. 46 (Cont.)

```
AACGCCGGGCTCACCTTTTCTTCATTCGATTTATGCTAAAAGCCGTAAAAACGGGAATTCGGCGCC
GTTGCAGAACCCGAATAGACGAATGAAGGAATGCAACTACCTTACACCGCTTGCGAAAGTGTCAGAAGA
TAATCTTGCAGAACCCGAATAGAGACGAATAGACGAATGAAGGAATGCAATCTTGACAGAGCCCGATTGCGTTATCTCCA
GGAGAAACATATAAAGCATCAACCGCTGATCGGACTAGAGTCACACTGGCTCACCACTGGCTCCTTCGGTGGGCCTT
TCTGGGTTTATACCTAGGGATATATTCCGCTTCCTCGCTCACTGACTCGCTACGCTCGGTCGTTCGACTG
CGGCGAGCGGGAAATGGCTTACGAACGGGGCGGAGATTTCCTGGAAGATGCCAGGAAGATACTTAACAGGG
AAGTGAGAGGCGCGGCAAAGCCGTTTTCCATAGGCTCCGCCCCCGACAAGCATCACGAAATCTGA
CGCTCAAATCAGTGGTGCCGAAACCCGGGAAATACCAGGCGTTCCCCTGGCGCTCCC
TCGTGCGCTCTCCTGTCCTGCCTTCCTGGTTACCGGTGTCATTCCGCGTGTTATGGCCGGTTGTCTCA
TTCCACGCCTGACACTCAGTTCGGTAGGCAGTTCGCTCCAAGCTGAGACTGTATGCACGAACCCCGT
TCAGTCCGACCGTGCGCCTTATCCGGTAACTATCGTCTGAGTCCAACCGGAAAGACATGCAAAAGCA
CCACTGGCAGCAGCCACTGGTAATTGATTAGAGGAGTTAGTCTTGAAGTCATGCGCCGGTTAAGGCTAA
ACTGAAAGGACAAGTTTGGTGACTGCGCTCCTCCAAGCCAGTTACCTCGGTTCAAAGAGTGGTAGCTC
AGAGACCCTCGAAAAACCGCCCTGCAAGGCCCTGTTTTTCGTTTTCAGAGCAAGCAAGAGATTACGCGCAGACC
AAAACGATCTCAAGAAGATCATCTTATTAATCGATAAAATATTCTAGATTTCAGTGCAATTACTTATCTCT
TCAAATGTAGCACCTGAAGTCAGCCCCATAACGATATAAGTTGTACTAGTCGCTTGGATTCTCACCAATAA
AAAACGCCCGGCAACCGAGCGTTCTGAACAAATCCAGATGGAGTTCTGAGTTCATTACTGGATCTAT
CAACAGGAGCGAGTCCAAGCTCGATATCAAATACGCCCGCCATCATCGCAGTACTGTGTAA
TTCATTAAGCATTCTGCCGACATGGAAGCAGAACCTGAATGCGCCAGCGCATC
AGCACCTTGTCGCCTGCGTATATATTGCCATGGTGAAAACGGGGCGAAGAAGTTGTCATATTGG
CCAGGTTAAATCAAACTGGTGAAACTCACCCAGGGATTGGCTGAGACGAAAACATATTCTCAATAAA
CCCTTTAGGGAAATAGGCCAGGTTTCACCGTAACACGCCACATCTGCGAATATATGTGTAGAAACTGC
CGGAAATCGTCGGGTATTCACTCCAGAGCGGATGAAAACGTTCAGTTTGCCATACGAAATTCCGGATGAGCATT
CATCAGGCGGCAAGAATGTGAATAAGGCCGGATAAAGCTTCTTAGCTACTGACAACTGAAAGCTTTTAAA
AAGGCCGTAATATCCAGGTAACGGTCTGGTTATAGTAGCAACTGAGCAACTGAACATGCCTCAAAT
GTTCTTTACGATGCCATTGGGATATATCAACGGTGGTATATCCAGTGATTTTTCTCCATTTAGCTTC
CTTAGCTCCTGAAAATCTGATAACTCAAAAATACGCCCGGTAGTGATCTTATTCATTATGGTGAAAG
TGGAACCTTCTTACGTGCCGATCAACGTCTCATTTCGCCAGATATCGACGTCTTAAGACCCACTTTCAC
ATTTAAGTTGTTTTCTAATCGGCATATGATCAATTCAAGGCGAATAAGAAGGCTGGCTGCACCTTG
GTGATCAAATAATTCGATAGCTTGTCGTAATAATGGGGCATACTATCAGTACTATCAGTAGGTGTTCCCTTTCT
TCTTTAGGGACTTGATGCTCTTGATCTTCCAATACGCAACCTAAAGTAAATGCCCACAGCGCTGAGTG
```

FIG. 46 (Cont.)

CATATAATGCATTCTCTAGTGAAAAACCTTGTTGGCATAAAAAGGCTAAATTGATTTCGAGAGTTTCATACTGTTTTCTGTAGGCCGTGTACCTAAATGTACTTTTGATCCATCGCGATGACTTAGTAAAGCACATCTAAACTTTTAGCGTTATTACGTAAAAAATCTTGCCAGCTTCCCTTCTAAAGGGCAAAAGTGAGTATGGTGCCTATCTAACATCTCAATGGCTAAGGCGTCGAGCAAAGCCCGCTTATTTTTACATGCCAAATACAATGTAGGCTGCTCTACACCTAGCTTCTGGGCGAGTTTAGGGTTGTTAAACCTTCGATTCCGACCTCATTAAGCAGCTCTAATGCGCTGTTAATCACTTTACTTTTATCTAATCTAGACATCAT (SEQ ID NO: 495)

FIG. 46 (Cont.)

Plasmid pLBH545_Tet-Cas14a1_Locus (Addgene Plasmid Number: 112501)

```
TTACTTTTATCTAATCTAGACATCATTAATTCCTAATTTTGTTGACACTCTATCGTTGATAGAGTTATT
TTACCACTCCCTATCAGTGATAGAGAAAAGAATTCAAAAGATCTAAAGGAGAAAGGATCTATGGCCAA
AAACACCATTACCAAAACTGAAAACTGTCGTATTGTGCGTCCGTATAATAGCGCAGAAGTGGAAAAATT
GTTGCCGACGAAAAAAACCGGAAAAATCGCACTGAAAAGAACAAAGACAAGTGAAGTGAAGAGCCT
GCAGCAAACATCTGAAAGTTGCAGCATATTGTACCACACAGGTTGAACGTAATGCCATGCCTGTTTGTAA
AGCACGTAAACTGGATGACAAATTCTACCAAAAACTGCGTGGTCAGTTTCCGGATGCAGTTTTTGCAA
GAAATCAGGCGAAATTTTCGCCAGCTGCAGAAACAGGCAGCAGAAAATCTATAATCAGAGCCTGATCGAAC
TGTACTACGAGATTTTTATCAAAGGCAAGTTATGCAAATGCCAGCAGCGGTTGAACATTATCTGAGTGA
TGTTGTTATACCGGTGCAGCAGAACTGTTTAAAACGCAGCAATTGCAAGCGGTCTGCGTAGCAAATC
AAAGCAATTTTCGTCTGAAAGAACTGAAAACATGAAAAACATGTGGTCTGCCGACCACCAAAGCGATAATT
TCCGATTCCGCTGGTTAAACAGAAGTGGTCAGTATACCGGTTTGAAATTAGCAATCATAATAGCGA
CTTCATCATCAAGATTCCGTTTGGTCGTTGGCAGGTCAAAAAGAGATTGATAATATCGTCCGTGGGAG
AATTTGACTTTGAACAGGTTCAGAAAAGCCGAAAACCGATTAGCCTGCTGAGCACCAGCGTCGTA
AACGTAATAAGGTTGGAGCAAAGATGAAGGCCACCGAAATCAAAAAAGTTATGAATGGCGATTA
TCAGACCAGTCTACATTGAAGTTAAACGTGGCAGCAAAATCGGTGAAAAAAGCGCATGGATGCTGAATCTG
AGCCAGTGATGATTGTCCGAAATTGATAAAGTTGATAAAGCCGAGCATTATTGGTGTATTGATGTTGGTGTTA
AATCAACCGCTGGTTTGCGCAATTAACAATGCATTAGCCGTTATAGCATCAGCGATAACGACCTGTTTCA
CTTCAACAAGAAAAATGTTGCACGTCGTATCCTGCTGAAAAAAAAGAGTCATAAACGTGCAGGTCAT
GGTGCAAAAACAACCGATCACCATTCTGACCGAAAAAAAGTGAACGTTTCGCAAAAGCTGA
TTGAACGTTGGGCATGTGAAATCGCGGATTTCTTCATTAAAAACAAAGTTGGCACCGTGCAGATGGAAAA
TCTGGAAAGCATGAAACTAAAGAGGACAGTCATATTTTAAACATTGCCTGCGCGTGGCCGTATGCA
GAAATGCAGAACAAAATCGAATTCAAACTGAAGCAGTATGGCATCGAAATTCGTAAGTTGCACCGAATA
ATACCAGCAAAACCGTAGCAAATGTGGCCATCGAACTATTCAACTTCGAGTACCGCAAGAAAAA
CAAATTCCGCACTTTAATGCGAAAAATGCAAACGCGAACTTCAAAGAAAACGCCGATTATAATGCAGCCTGAAT
ATTTCAAAACCCGAAACTGAAAAGCACCAAAGAGGAACGTAAATATTATACTTATTATCCTTCATTGA
CAAAATGAGAATGTTATCCCAGATAACATTTGATGTACACAGATTCACACTTCACTGATAAAGTGGAGA
ACCGCTTCACCAAAGCTGTCCCTTAGGGATTAGAACTTGAGTGAAGGTGGGCTGCTTGCATCAGCCTA
ATGTCGAGAAGTGCTTCTTCGGAAAGTAACCCTCGAAACAAATTCATTTTCCTCTCCAATTCTGCACA
```

FIG. 46 (Cont.)

```
AAAAAGGTGAGTCCTTATAAACCGGGCGTGCAGAACGCGGCTCACCTTTTTCTTCATTCGATTTATG
CTTAAAGCCGTAAAAACGCGTAATTCGGCGCCGTTGCAGAACCGGCAGAACCCGAATGAGACGAATGCAAC
TACCTTACACCGCTTGCGAAAGTTGTCAGAAGATAATCTTGCAGAACCCGAATAGACGAATGAAGGAATG
CAAATCTTGACAGAGCCCGATTGCGTTATCTCCAGGAGAAACATATAAAGCATCAACCGCTGATGGACT
AGAGTCACACTGGCTCACCTTCGGGCTCTTCTGCGTTATACCTAGGGATATATTCCGCTTCCTCG
CTCAACTGACTCGCTCGGTCGTTCGACTGCGGGCAGCGGAAATGGCTTACGAACGGGGCGGAGATT
TCCTGAAGATGCCAGGAAGATACTTAACAGGGAAGTGAGAGGGCCGGCAAAGCCGTTTTCCATAGG
CTCCGCCCCCTGACAAGCAATCACGAAATCTGACGCTCAAATCAGTGGTGGCGAAACCCGACAGGACTAT
AAAGATACCAGGCGTTTCCCCCGTGGCTCCCTGCTCCGTCACGCTCAGTTCCGGTAGGCAGTTCG
TGTCATTCCGTCTGTTATGCGGACTGTATGCAGAACCCCCGTTCAGTCGACCGCCTTATCCGTAACTATCGT
CTCCAAGTCGGACTGTATGCAGAACCCCCGTTCAGTCGACCGCCTTATCCGTAACTATCGT
CTTGAGTCGCAACCCGGCAAAGAGACATGCAAAGCACCACTGGCAGCAGCCACTGGTAATTGATTTAGAGGAG
TTAGTCTTGAAGTCATGCGCCGGTTAAGGCTAAACTGAAAGGACAAGTTTTGGTGACTGCGCTCCTCCAA
GCCAGTCACCTCGGTTCAAGAGTTGGTAGTCGCAAACGCCCTGCAAGCGGTTTT
TTCGTTTTTCAGAGCAAGAGATTACGCGCAGACCAAAAAGCTCAAGAAGATCATCTCTTATTCAGATA
AAATATTCTAGATTTCAATGCAATTTATCCTCCAAATGTAGCACTGAAGTCAGCCCATACGATATA
AGTTGTTACTAGTGCTTGGATTCTCACCAATAAAAACCGCCCGGCAACCGAGCGTTCTGAACAATC
CAGATGGAGTTCTGAGGTCATTACTGATCTATCAACAGGAGTCCAAGCAGTCGATATCAAATTACGC
CCCGCCCATCATGCAGTACTGTTGTAATTCATTAAGCATTCTGCGACATGAAGCAGCCATCACAA
ACGGCATGATGAACCTGAATGCCAGCAGCACCCTTGTCGCCTTGCCTTGGTATAATATTTGCCATGG
TGAAAAACGGGGGAAGAAGTTGTCCATATTGGCCACGTTTAAATCAAAACTGGTGAAACTCACCCAGGG
ATTGGCTGAGACGAAAAACATATTCTCAATAAACCCTTTAGGGAAAATAGGCCAGTTTCACCGTAACAC
GCCACATCTTGGGAAATCGTTGTAGAAACTGGTAACAAGGGTGAACAACATCCATATCCACCAGCTGAAA
ACGTTCAGTTGCTCATGGAACGAAATTCCGATGAGCATTCATCAGGCGGGCAAGAATCGGTTGAATAAAGGCCGGATAA
TTTCATTGCCATACGAAATTCCGGATCTTTAAAAAGGCCGTAATATCCAGCTGAATATCGGTCGGTTATAGG
TACATTGAGCAACTGACTGAAATGCCTCAAATGTTCTTACGATGCCATTGGATATATCAACGGTGGT
ATATCCAGTGATCTTATTCATTAGGTGAAAGTTGAAGTTGAACCTTACGTGCCGATCAACGTCTCATTTC
CCCGTAGTAGTATATGGACTTAAGACCCACTTCAAGACCCACTTTCTTCAGAAGTTGTTTTCTAATCCGCATATGATCAATTC
GCCAGATATGCGACGTTAAGAGACCCACTTCAAGTTGAAGTTGTTTTCTAATCCGCATATGATCAATTC
AAGGCCGAATAAGAAGCCTGGCTCTGCACCTGGTGATCAAATAATTCGATAGTGCGTAATAATGGC
GGCATACTACCAGTAGTAGGTGTTTCCCTTCTTTAGCGACTGATGCTCTTGATCTTCCAATACGC
```

FIG. 46 (Cont.)

AACCTAAAGTAAATGCCCACAGCGCTGAGTGCATATAATGCATTCTAGTGAAAAACCTTGTTGGCATAAAAGGCTAATTGATTTTCGAGAGTTTCATGTTTTCTGTAGGCCGTTACTAAATGTACTTTTGCTCCATCGCGATGACTTAGTAAAGCACATCTAAAACTTTAGCGTTATTACGTAAAAATCTTGCCAGCTTTCCCTTCTAAAGGGCAAAAGTGAGTATGGTGCCTATCTAACATCTCAATGGCTAAGGGCTGAGCAAAGCCCGCTTATTTTACATGCCAATACAATGTAGGCTGCTCTACACCTAGCTTCTGGGCGAGTTTACGGGTTGTTAAACCTTCGATTCCGACCTCATTAAGCAGCTCTAATGCGCTGTTAATCACT (SEQ ID NO: 496)

FIG. 46 (Cont.)

Plasmid pLBH531_MBP-Cas14a1 expression (Addgene Plasmid Number: 112500)

```
ACCCACGCCGAAACAACAAGGCTCATGAGCCCGAAGTGGCGAGCCCGATCTTCCCCATCGGTGATGTCGGCG
ATATAGGGCCCAGCAACCGCAACGCACCTGTGGCGCCGGTGATGCCGGCCACGATGGCTCCGGCGTAGAGGATCG
AGATCTCGATCCCGCGAAATTAATACGACTCACTATAGGGAGACCAACAACGGTTCCCTCTAGTGCGGC
TCCGGAGCTCTTTAATTAAGCGGCCGCCGACTCAGGACTGAGTTCTAGAAATAATTTTGTTTAACTTT
AAGAAGGAGATATACATATGAAATCTTCTACCATCACCATCACCATCACCATCACCATGGTCTCTAT
GAAATCGAAGAAGGTAAACTGGTAATCTGGATTAACGGCGATAAAGGCTATAACGGTCTCGCTGAAGTC
GGTAAGAAATTCGAGAAAGATACCGGAATTAAAGTCACCGTTGAGCATCCGGATAAACTGGAAGAGAAAT
TCCCACAGGTTGCGGCCACTGGCGAATCACCCGGACAAAGCGTTCCAGGACAAGCTGTATCCGTTTACC
CGCTCAATCTGGCCTGTTGGCTGAAATCACCCCGGACAAAGCGTTCCAGGACAAGCTGTATCCGTTTACC
TGGGATGCCGTACGTTACAACGGCAAGCTGATTGCTTACCCGAAGTCGTTGAAGCGTTATCGCTGATTT
ATAACAAAGATCTGCCGAACCCGCAAAACCTGGGAAGAGATCCTCAACCTGACTACTTCACCTGGCCGCTGATTGCTGCT
AGCGAAAGGTAAGAGCGCGCTGATGTTCAAGTGAAAACGGCAGTACGACATTAAAGACGTGGCGTAACGCTG
GACGGGGTTATGCGTTCAAGTGATATGAAGCGCAGTACGACATTAAAGACGTGGCGTGATAACGCTG
GCGGGAAAGCGGGGTCTGACCTTCCTGGTTGACCTGATTAAAACAACACATGAATGCAGACACCGATTA
CTCCATGCGCAGAACACCAGCAAAGTGAATTATGTGTAACGGTACTGCCGACCTTCAAGGTCAACCATCCAAAC
AACATGACACCAGCAAAGTGAATTATGTGTAACGGTACTGCCGACCTTCAAGGTCAACCATCCAAAC
CGTTCGTTGGCGCTGTGAGCGCAGGTATTAACGCGCCAGTCCGAACAAAGAGTGGCAAAGAGTTCCT
CGAAAACTATCTGTGACTGATGAAGGTCTGAAGGTTAATAAAGACAAACCGCTGGTGCCGTAGCG
CTGAAGTCTTACGAGGAGAGTTGGCGAAAGATCCACGTTTCTGGTATGCCGTTGCCTACTGCGGTGATCAACGC
GTGAAATCATGCGGAGAACATCCCGCAGATGTCCGCTTTCTGGTATGCCGTACTGCGGTGATCAACGC
CGCCAGCGGTCGTCAGACTGTCGATGAAGCCCTGAGAAAGACGGCAGACTAATTCGAGCTCGAACAACAAC
AACAATAACAATAAACAACTGGAGGAAACCGTACTTCCAATCAATGGCCAAAA
ACACCATTACCAACCGCGAAAAATCGCACTGGAAAGAACAAAGACAAAGTGAAGAAGCCTGC
TGCCGGACGAAAACTGAAACTGCAGCATATGTACCACACAGGTTGAAGTCATGCCTGTTTTGTAAAG
AGCAAACATCGAAGTTGCAGCATATGTACCACACACAGGTTGAAGTCATGCCTGTTTTGTAAAG
CACGTAAACTGGATGACAATTCTACCAAAACTGGGGTCAGTTTCCGGATGCAGTTTTTGGCAAGA
AATCAGGAGAATTTTTGCCAGCTGCAGAAACAGGCAGCAGAAATCTATAATCAGAGAGCCTGAACTG
```

FIG. 46 (Cont.)

```
TACTACGAGATTTTATCAAAGGCAAAGGTATTGCAAATGCCAGCAGCGTTGAACATTATCTGAGTGATG
TTTGTTATACCCGTGCAGCAGAACTGTTTAAAACGCAGCAATTGCAAGCGGTCTGCGTAGCAAATCAA
AGCAATTTCGTCTGAAAGAACTGAAAACATGAAAAGTGGTCTGCCGACCACCAAAAGCGATAATTTT
CCGATTCCGCTGGTAACAGAAGGTGTCAGTATACCGGTTTGAAATTAGCAATCATAATAGCGACT
TCATCATCAAGATTCCGTTGGTCGTTGGCAGGTCAAAAGAGATTGATAAATATCGTCCGTGGGAGAA
ATTTGACTTTGAACAGGTTCAGAAAAGCCCGAAAACGATTAGCCTGCTGCAGCACCCAGCGTCGTAAA
CGTAATAAAGGTTGGAGCAAAGATGAAGGCACCGAAGCCGAAATCAAAAAAGTTATGAATGGCGATTATC
AGACCAGCTACATTGAAGTTAAACGTGGCAGCAAATCTGTGAAAAAAGGCATGGATGCTGAATCTGAG
CATTGATGTCCGAAATTGATAAGGTGTGGCACGTCGTATCCTGCAATTATTGGTGGTATGTGGTGTAAA
TCACCGCTGGTTTGCGCAATTAACAGTTGCACGTGCTCGTATCCATTTAGCCGTTATCAGCGATAACGACCTGTTTCACT
TCAAACAAGAAAATGTTTGCACGTCGTATCCATTTAGCCGTTATCAGCGATAACGACCTGTTTCACT
TGCAAAACAAACTGAACCGATCACCATTCTGACCGAAAAAGTGAACGTTTCGCAAAAGCTGATT
GAACGTTGGGCATGTGAAATCGGGATTTCTCATTAAAAACAAAGTTGGCACCGTGCAGATGGAAAATC
TGGAAAGCATGAAACGTAAAGAGGACAGTCATTTAACATTGCCTGCTGCGTTTGCCGTATGCAGA
AATGCAGAACAAAATCGAATTCAAACTGAAGCAGTATGGCCATCGAAACAATTCAACTCGAGTGCACGAATAAT
ACCAGCAAAACCTGTAGCAACTGGCCATCGAAAATGCAACTATTCAAATGCACTTCGAGTACCGCAAGAAAACA
AATTCCCGCACTTAAATGCGAAACACCAAAGAACGCGTAATAACATTGGAAGTGGATAACGGATCCGCGA
TTCAAACCGCACTTAAATGCGAAAGCACCACTGGCGCATCCAAGAAACGCGTAATAACGGATCCGCGA
TCGCGGCGGCCACCTGGCGTGCCTGCCACCGGTTACCACCGGCGATCCGGCTGCTAACAAGCCCGA
AAGGAAGCTGAGTTGGCTGCTGCCACCGCAATAGCATAACCCCTTGGGGCCTCTAAACGGG
TCTTGAGGGTTTTTGCTGAAAGGAGAACTAGTCCGGATATCCACAGAACGGGGTGTGGTCGCCATGA
TGCGGTAGTGGATAGTGGCTCCAAGTAGCAAGGAGCAGGAGCTGGGGGCCAAGCGGTCGGACAG
TGCTCCGAGAACGGGGTGGCATAGAAATTGCATCAACGCTAGCGCACGCCATAGTGACTG
GCGATGCTGTCGGAATGGACGATATCCGCAAGAGCCGGCAGTACCGGCATACCAAGCCTATGCCTA
CAGCATCCAGGGTGAGCGTGCCGAGGATGACGATGAGGCGCATTGTTAGATTTCATACACGGTGCCTGACT
GCGTTAGCAATTAACTGTGATAAACTACCGCATTAAAGCTATGATGAAGCTGTCAAACATGAGAA
TTCTTGAAGACGAAAGGGCCTGATACGCCTATTTTATAGGTTAATGTCATGATAATAATGGTTTCT
TAGAGTCAGGTGGCACTTTCGGGAAATGTGCGGGAAACCCCTATTGTTATTTTCTAAATACATT
CAAATATGTATCGGCTCATGAGACAATAACCCTGATAAATGCTTCAATAACATTGAAAAGGAAGAGTAT
GAGTATTCAACATTCCGTGTCGCCCTTATTCCCTTTTTTGCGGCATTTTGCCTTCCTGTTTTGCTCAC
CCAGAAACGCTGGTGAAAGTAAAAGATGCTGAAGATCAGTTGGGTGCACGAGTGGGTTACATCGAACTGG
```

GCGGCGGGACCAGAGAAAAATCACTCAGGGTCAATGCCAGCGCTTCGTTAATACAGATGTAGGTGTTCCA
CAGGGTAGCCAGCAGCATCCTGGATGCAGATCCGGAACATAAATGGTGCAGGGGCGTGACTTCCGGTTT
CCAGACTTACGAAACACGGAAACCGAAGACCATTCATGTTGTTGCTCAGGTCGCAGACGTTTGCAGCA
GCAGTGCGCTTCACGTTCGCTCGGGTATCGGTGATTCATTCTGCTAACCAGTAAGGCAACCCGCCAGCCT
AGCCGGGTCCTCAACGACAGGAGCACGATCATGCGCACCCGTGCCAGGACCCAAGCGCTGCCGAGATGC
GCCGCGTGCGGCTGTGGAGATGGCGGACGCGATGGATATGTTCTGCCAAGGGTTGGTTTGCGCATTCAC
AGTTCTCCGCAAGAATTGATTGGCTCCAATTCTTGGAGTGGTGAAATCCGTTAGCGAGGTGCCGCGCTT
CCATTCAGGTCGAGGTGTGCCCGGCTCCATGCCAGCCGACGCAACGCGGGAGGCAGACAGGTATAGGC
GGGCCTACAATCCATGCCAACCCGTTCGCTGCCGAGGCGGCATAAATCGCCGTGACGATCAGC
GGTCCAATGATCGAAGTTAGGCTGGTAAGAGCCCGGAGCGATCCTGAAGCTGTCCCTGATGGTCGTCAT
CTACCTGCCTGGACAGCATGGCCTGCAACGCGGGCATCCGATGCCGCCGGAAGCGAGAAGAATCATAAT
GGGAAGGCCATCCAGCGCCTCGGGTCGCGAACGCCAGCAGCGTAGCAGCCCCAGCGCGCCATGCCG
GCGATAATGGCCTGCTTCTGCCCGAAACGTTTGGTTGCGGGACCAGTGACGAAGGCTTGAGCGAGGCGT
GCAAGATTCCGAATACCGGCAAGCGACAGGCCGATCGTCGCCAGCGAAAGGGTCCTGCCGAA
AATGACCCAGAGCGCTGCCGGCACCTGTCCTACGAGTTGCATGATAAAGAAGACAGTCATAAGTGCGGCG
ACGATAGTCATGCCCGCCCCACCGGAAGGAGCTGACTGGGTTGAAGGCTCTCAAGGCATCGGTCGAC
GCTCTCCCTTATGCGACTCCTGCATTAGGAAGCAGCCCAGTAGTAGGTTGAGCCGTTGAGCACCGCGC
CGCAAGGAATGGTGCATGCAAGGAGATGGCGCCCAACAGTCCCCCGGCCACCGGGCCTGCCACCAT (SEQ ID NO. 497)

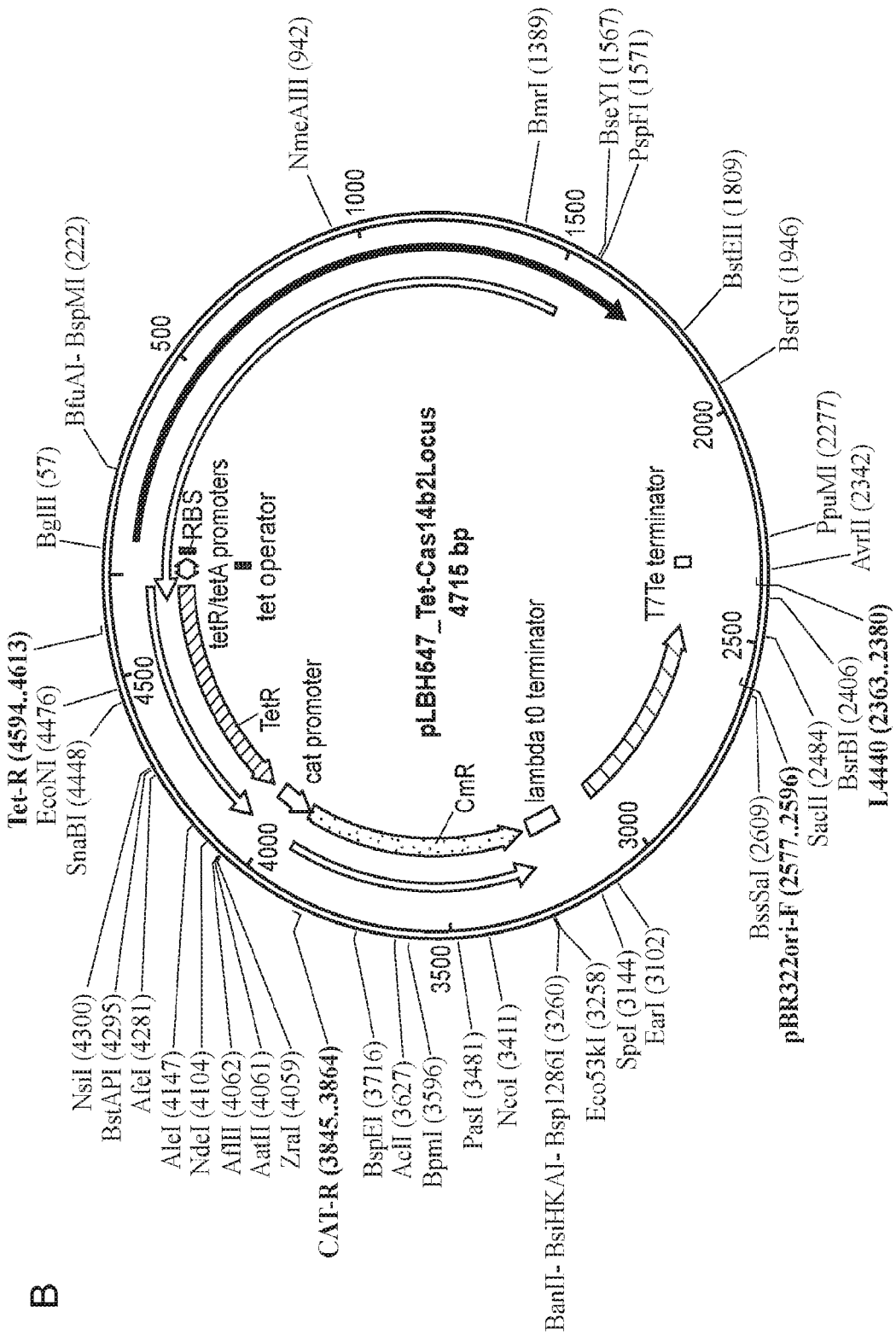
FIG. 47 (Cont.) B

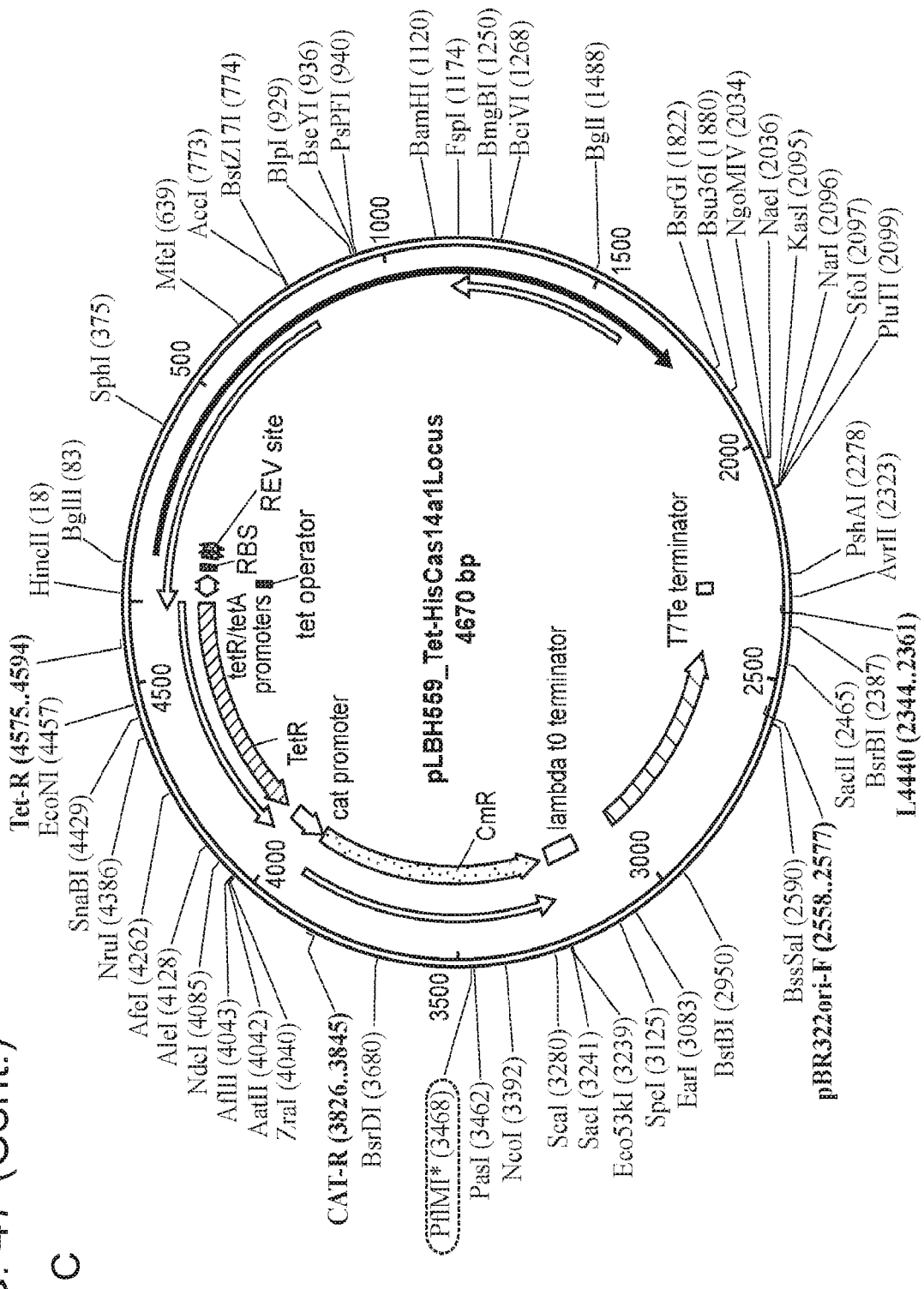
FIG. 47 (Cont.) C

D

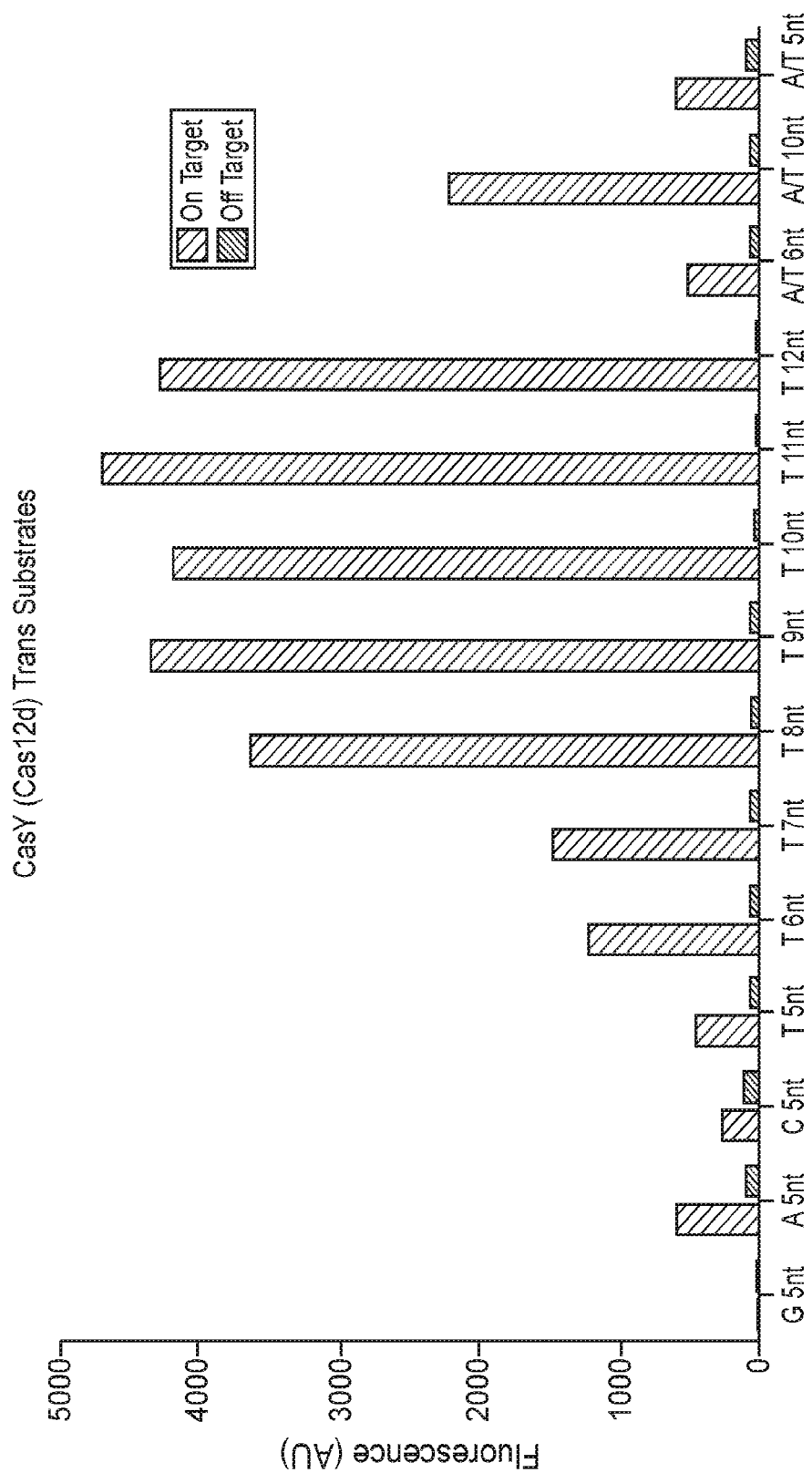

ID NO:5); AsCpF1_5B43: (SEQ ID NO:29);
CLASS 2 CRISPR/Cas COMPOSITIONS AND METHODS OF USE

CROSS-REFERENCE

This application is a national stage filing under 35 U.S.C. § 371 of PCT/US2018/058529, filed Oct. 31, 2018, which claims the benefit of U.S. Provisional Patent Application No. 62/580,394, filed Nov. 1, 2017, which applications are incorporated herein by reference in their entirety.

STATEMENT REGARDING FEDERALLY SPONSORED RESEARCH

This invention was made with government support under 1244557 and 0626526 awarded by the National Science Foundation and under DE-AC02-05CH11231 awarded by the Department of Energy. The government has certain rights in the invention.

INCORPORATION BY REFERENCE OF SEQUENCE LISTING PROVIDED AS A TEXT FILE

A Sequence Listing is provided herewith as a text file, "BERK-373WO_SEQ_LISTING_ST25.txt" created on Oct. 30, 2018 and having a size of 809 KB. The contents of the text file are incorporated by reference herein in their entirety.

INTRODUCTION

The CRISPR-Cas system, an example of a pathway that was unknown to science prior to the DNA sequencing era, is now understood to confer bacteria and archaea with acquired immunity against phage and viruses. Intensive research has uncovered the biochemistry of this system. CRISPR-Cas systems consist of Cas proteins, which are involved in acquisition, targeting and cleavage of foreign DNA or RNA, and a CRISPR array, which includes direct repeats flanking short spacer sequences that guide Cas proteins to their targets. Class 2 CRISPR-Cas systems are streamlined versions in which a single Cas protein (the effector protein) bound to RNA is responsible for binding to and cleavage of a targeted sequence. The programmable nature of these minimal systems has facilitated their use as a versatile technology that is revolutionizing the field of genome manipulation

SUMMARY

The present disclosure provides compositions and methods that include one or more of: (1) a Class 2 CRISPR/Cas effector protein, a nucleic acid encoding the effector protein, and/or a modified host cell comprising the effector protein (and/or a nucleic acid encoding the same); (2) a CRISPR/Cas guide RNA that binds to and provides sequence specificity to the effector protein, a nucleic acid encoding the guide RNA, and/or a modified host cell comprising the guide RNA (and/or a nucleic acid encoding the same); and (3) a CRISPR/Cas transactivating noncoding RNA (trancRNA), a nucleic acid encoding the trancRNA, and/or a modified host cell comprising the trancRNA (and/or a nucleic acid encoding the same).

BRIEF DESCRIPTION OF THE DRAWINGS

FIG. 1. depicts examples of naturally occurring Class 2 CRISPR/Cas effector proteins.

FIG. 2. depicts results acquired from PAM dependent plasmid interference experiments performed to determine a PAM sequence for Cas12c_1 (C2c3_1).

FIG. 8 depicts an alignment of naturally occurring CasY protein sequences and a zoom in of catalytic amino acids. (Top to bottom: CasY1: (SEQ ID NO:1); CasY2: (SEQ ID NO:2); CasY3: (SEQ ID NO:3); CasY4: (SEQ ID NO:4); CasY5: (SEQ ID NO:6); CasY6: (SEQ ID NO:7); CasY7: (SEQ ID NO:5); AsCpf1_5B43: (SEQ ID NO:29); LbCpf1_5ID6: (SEQ ID NO:30)).

FIG. 12 (panels a-c) presents 'repeat' sequences of naturally occurring CasY guide RNAs (the non-guide seqeunce portion of CasY guide RNAs), an example of a CasY guide RNA hybridizing to target DNA, and trancRNAs for three different CasY proteins.

FIG. 16. presents data from CasY trancRNA deletion experiments.

FIG. 17. depicts a schematic representation of natural CasY loci.

FIG. 18. depicts schematic representations of CasZ loci, which include a Cas1 protein in addition to the CasZ protein.

Figure 19:
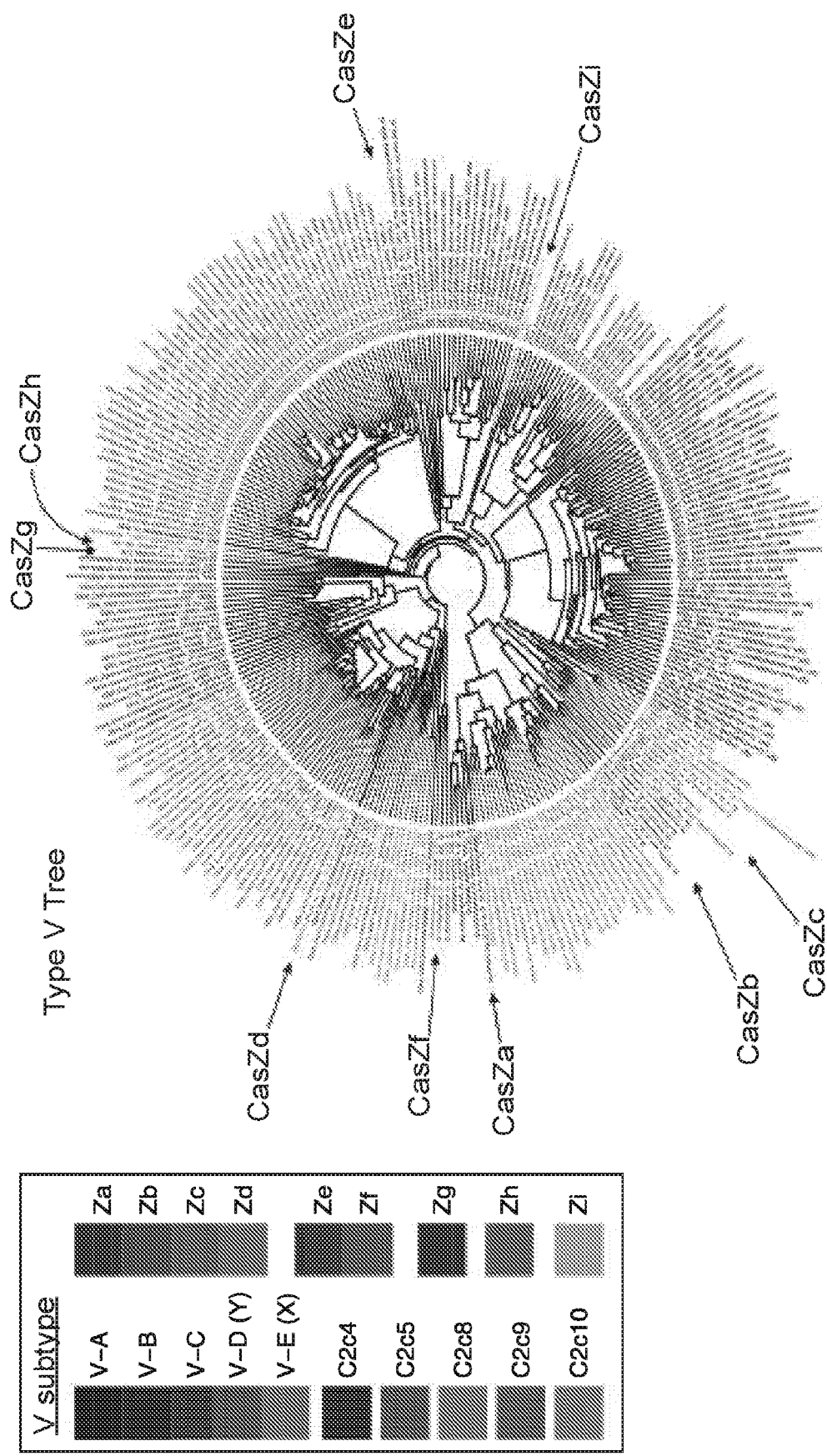

FIG. 19. depicts a phylogenetic tree of CasZ sequences in relation to other Class 2 CRISPR/Cas effector protein sequences.

Figure 20:
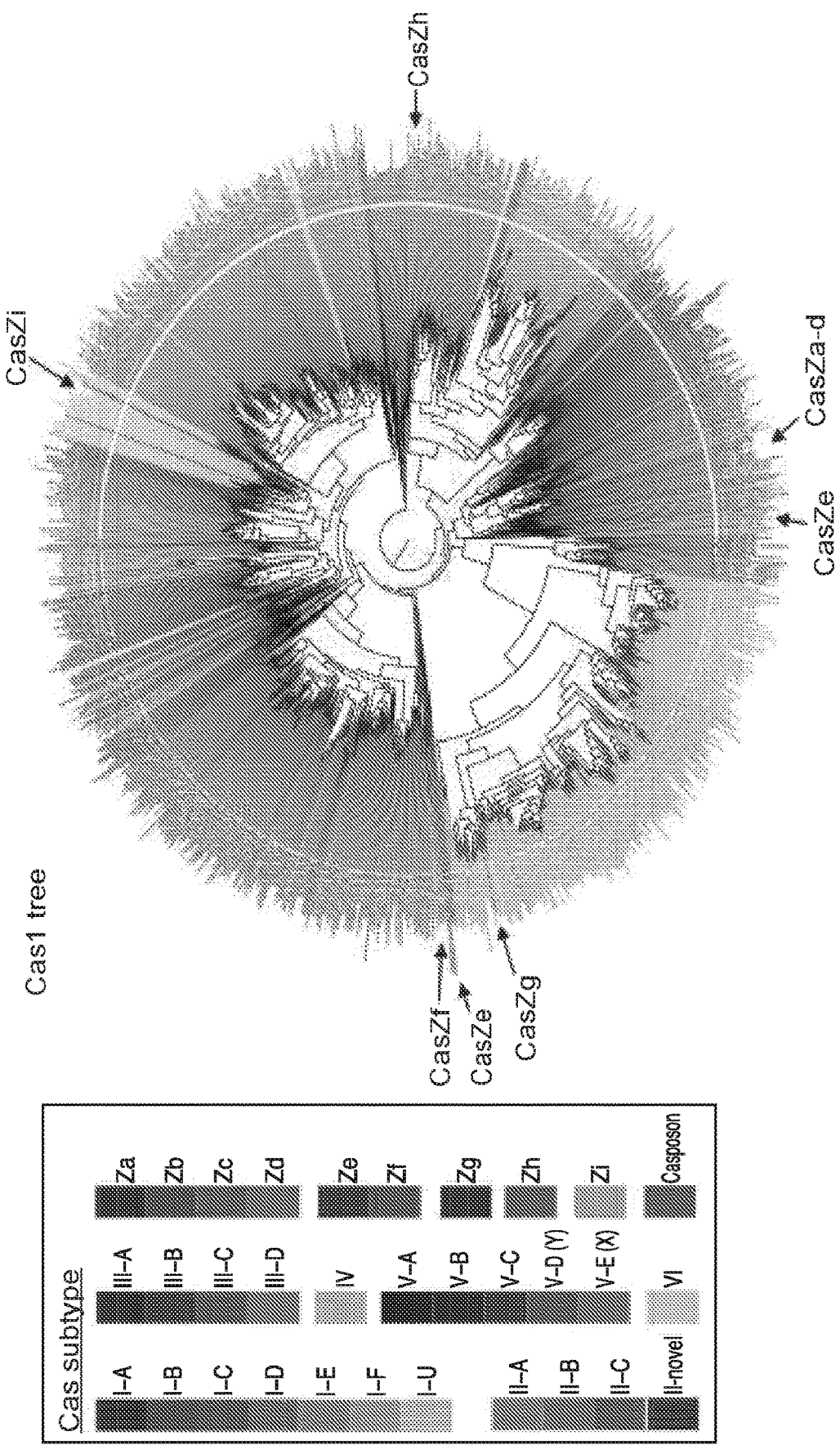

FIG. 20. depicts a phylogenetic tree of Cas1 sequences from CasZ loci in relation to Cas1 sequences from other Class 2 CRISPR/Cas loci.

Figure 21:
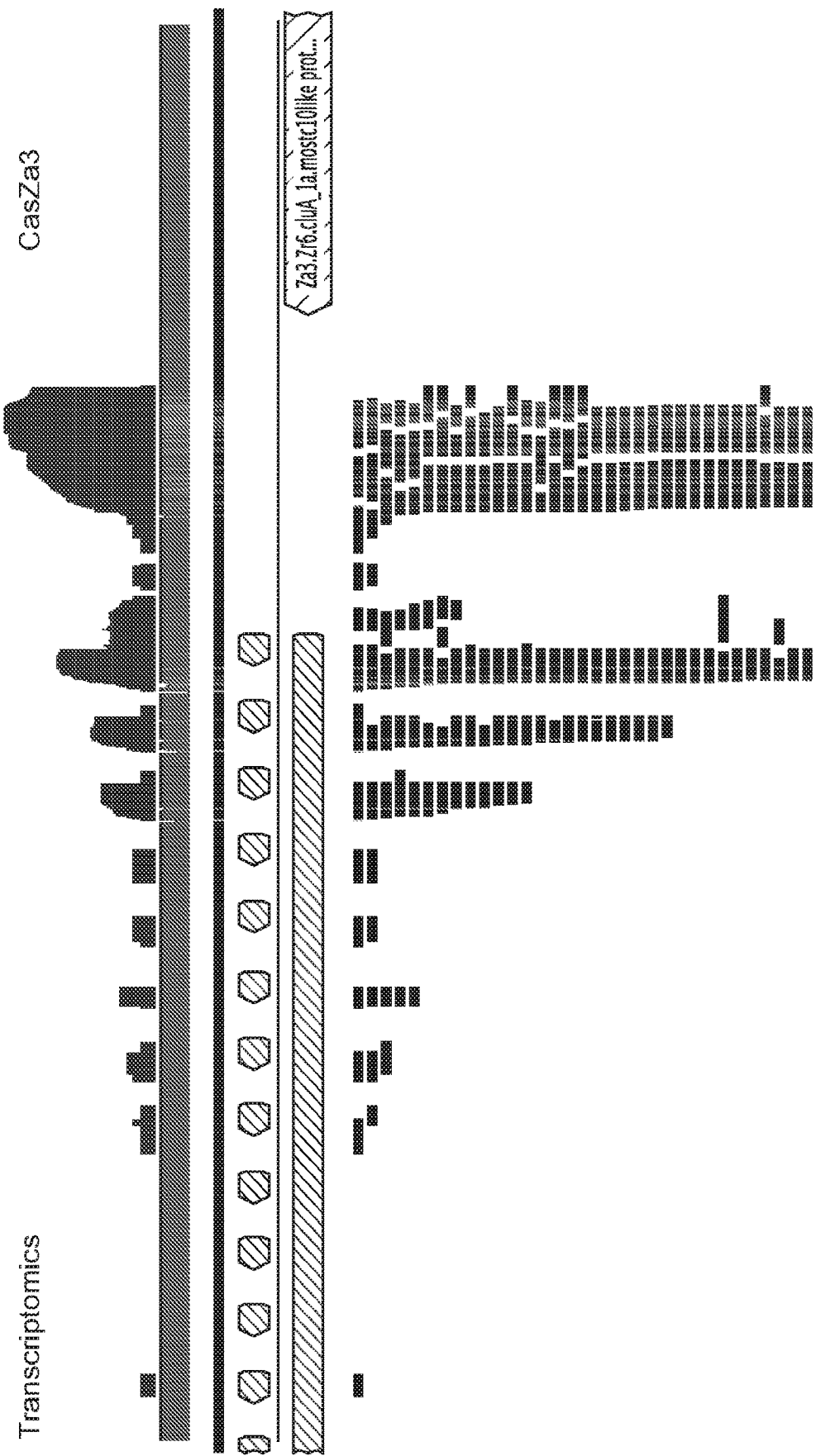
Figure 21:
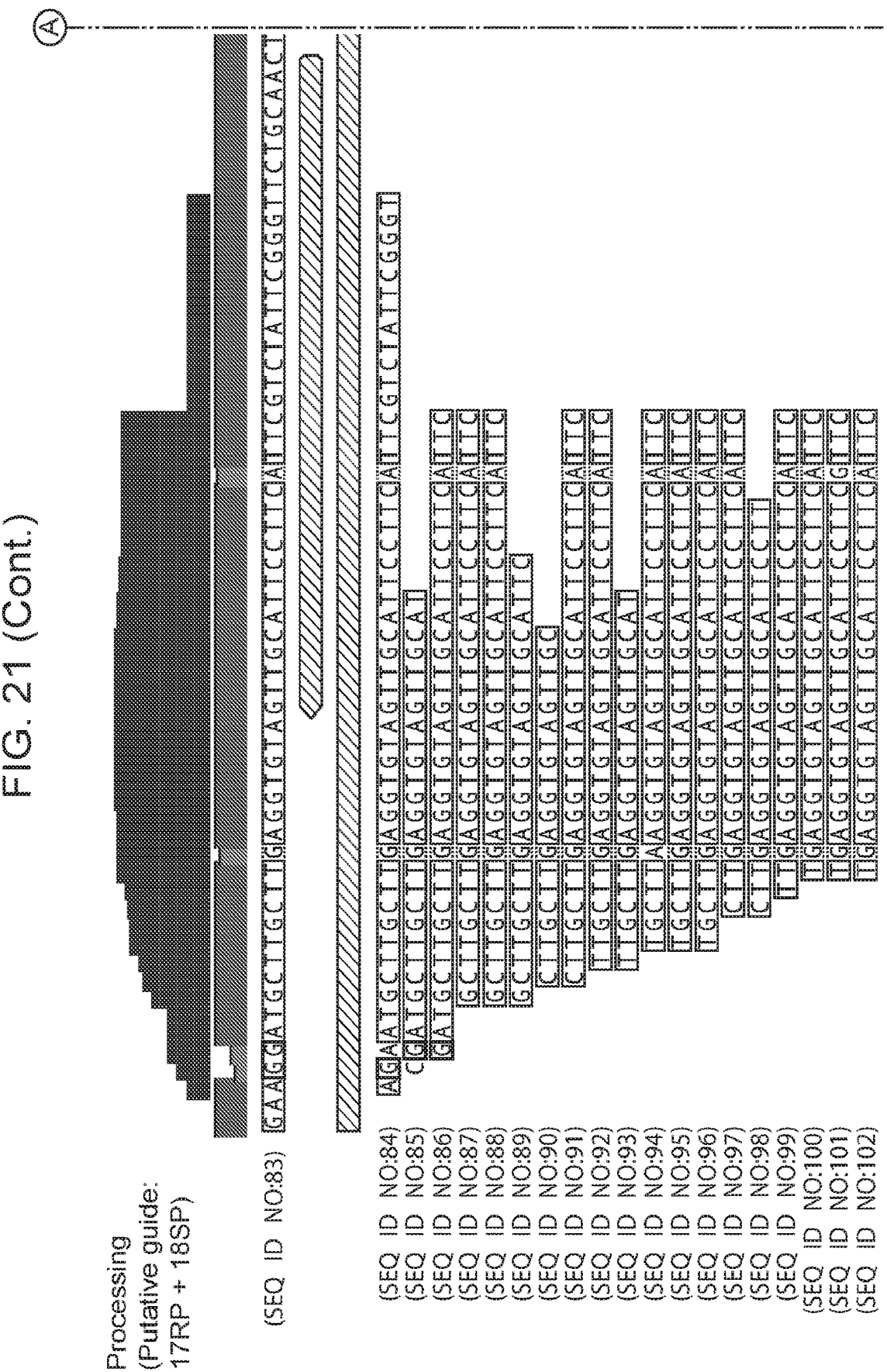
Figure 21:
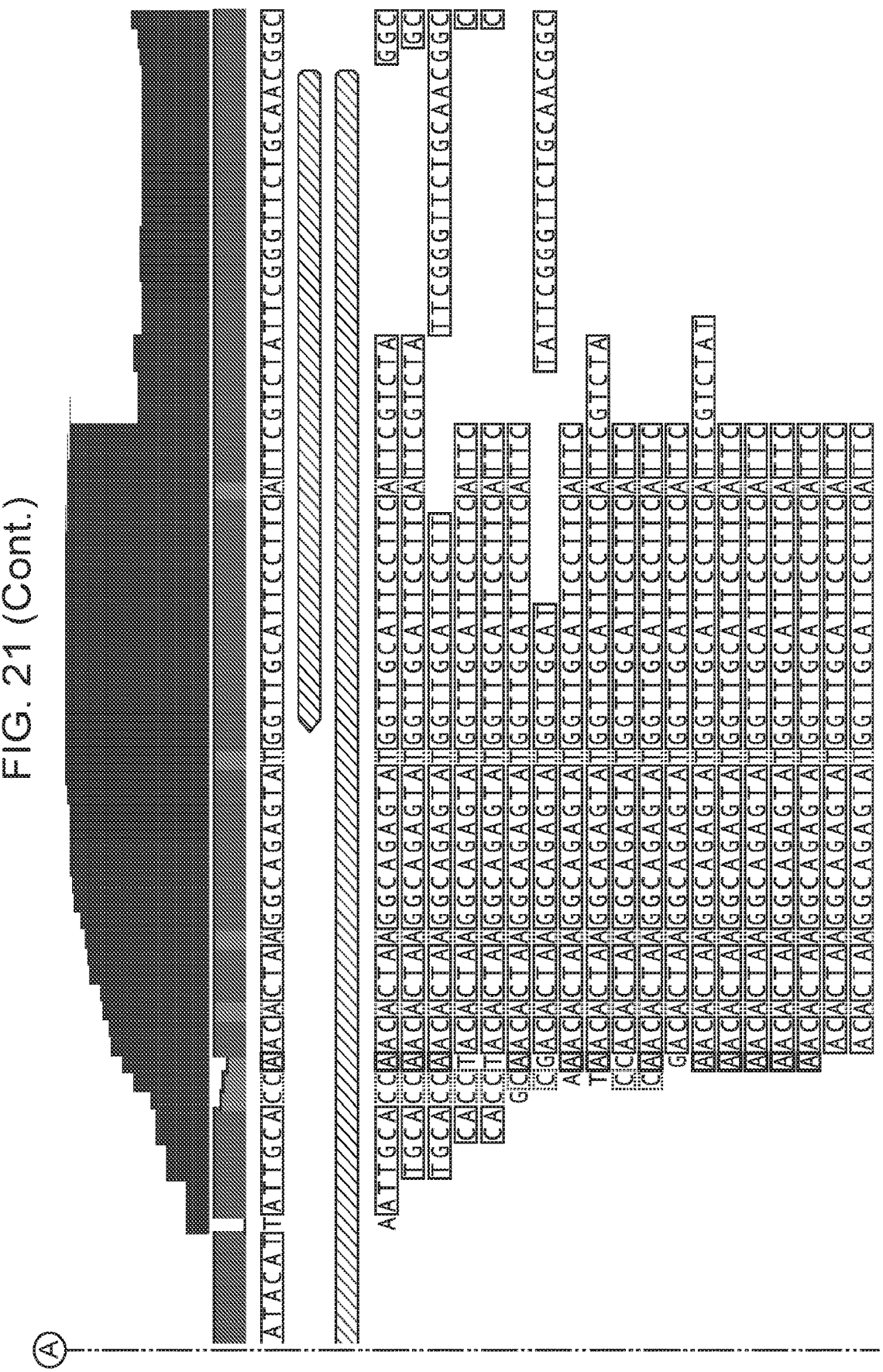
Figure 21:
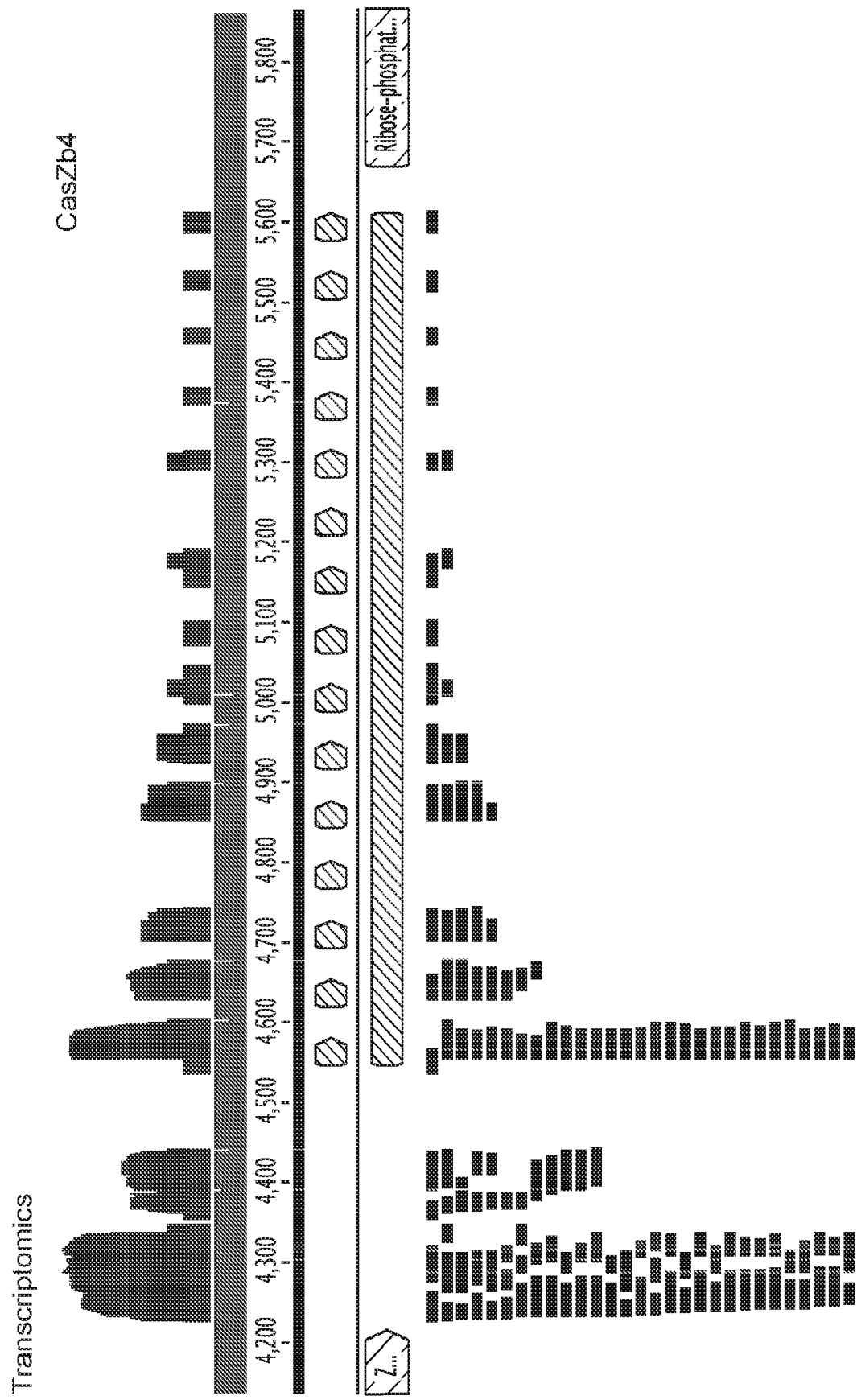
Figure 21:
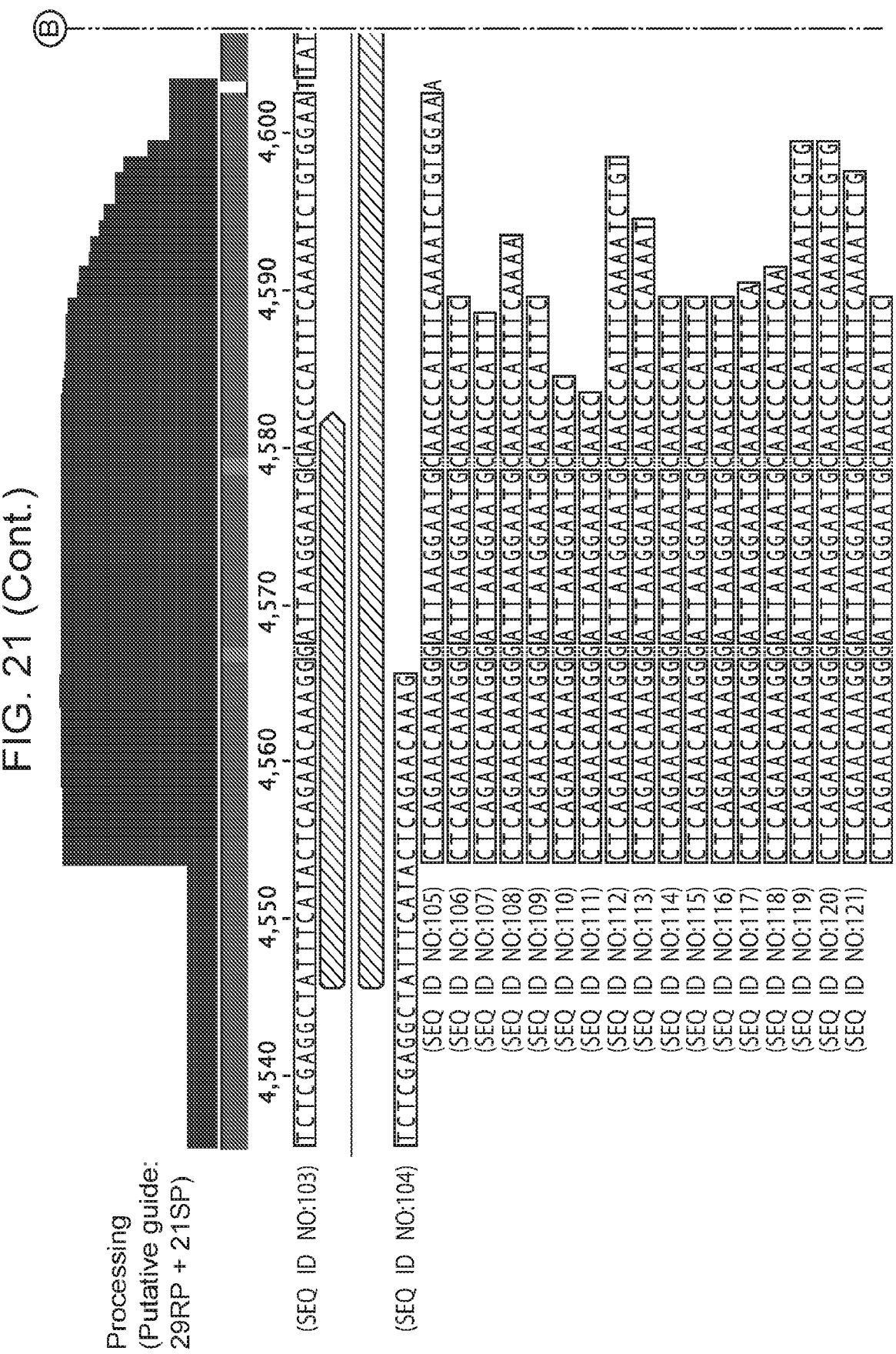
Figure 21:
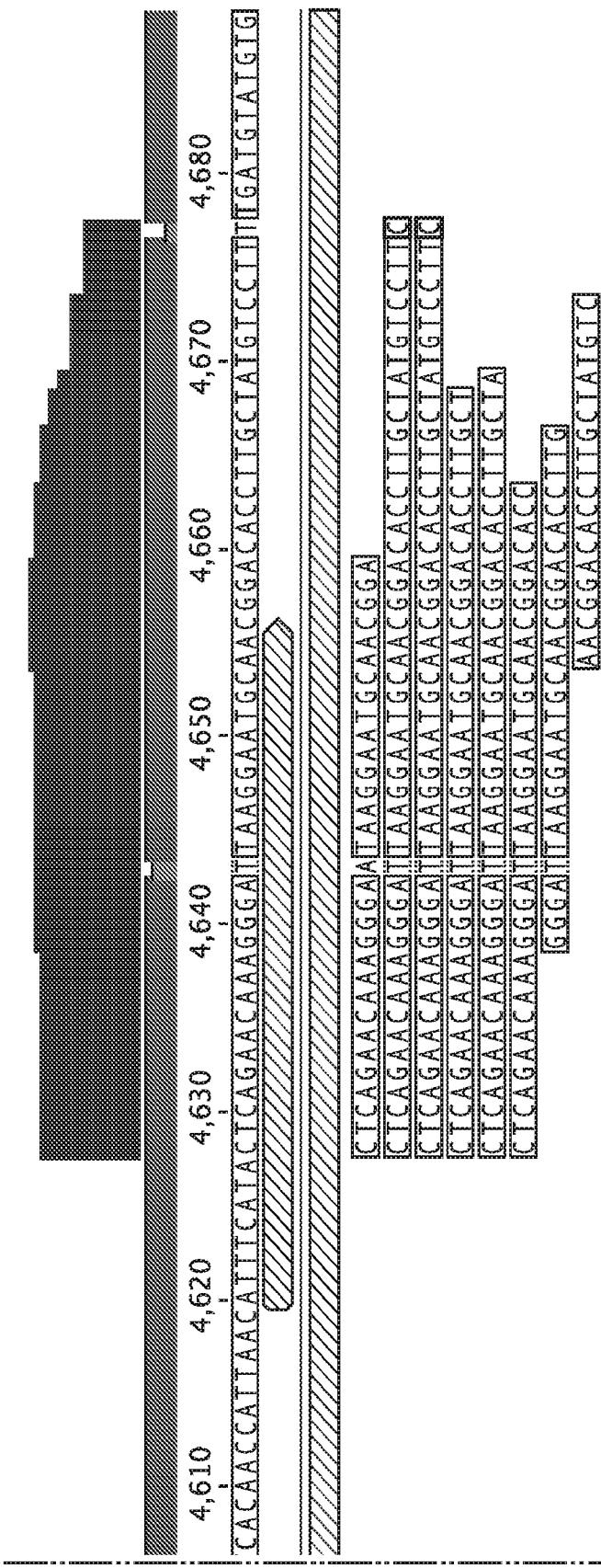
Figure 21:
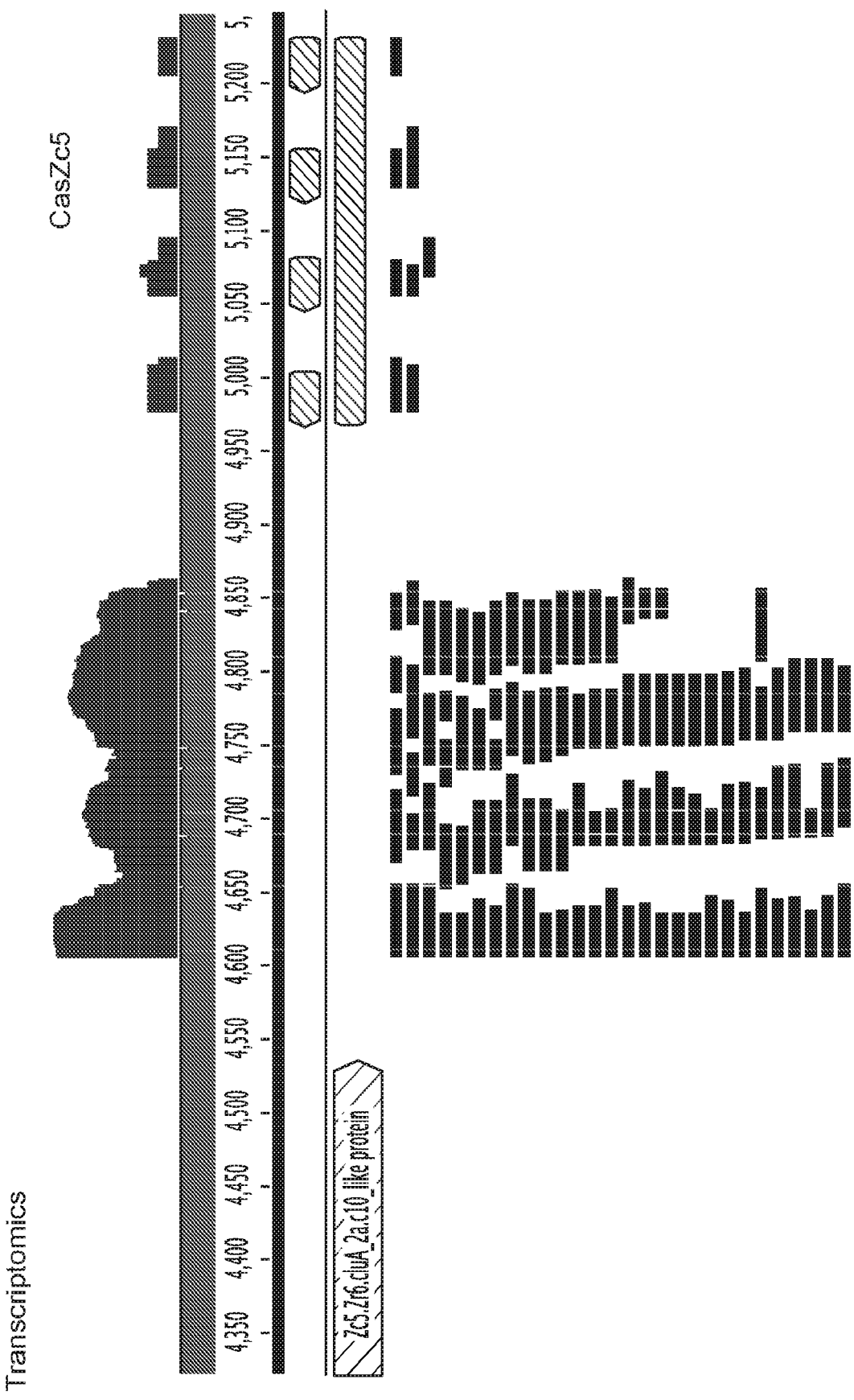
Figure 21:
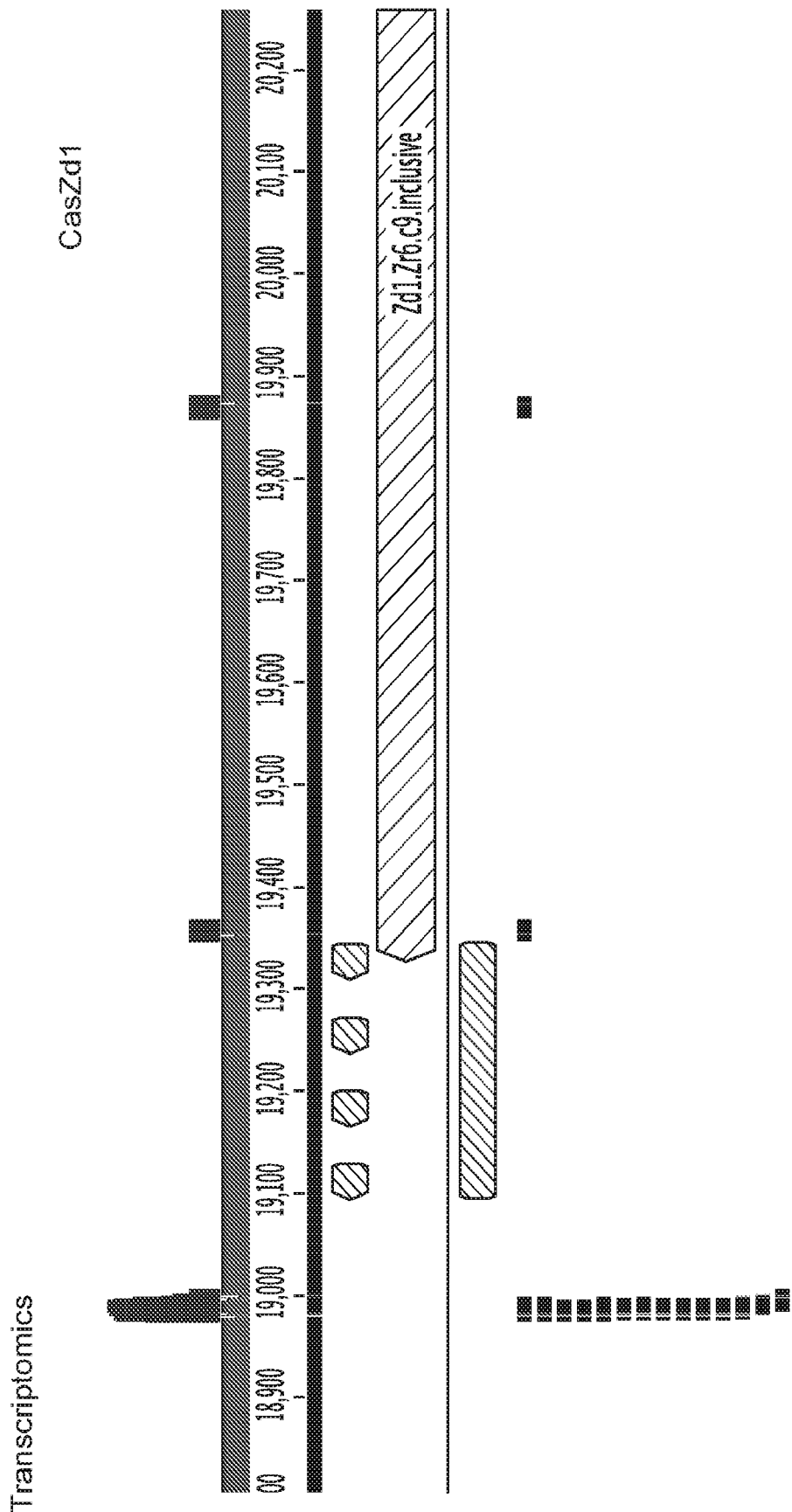
Figure 21:
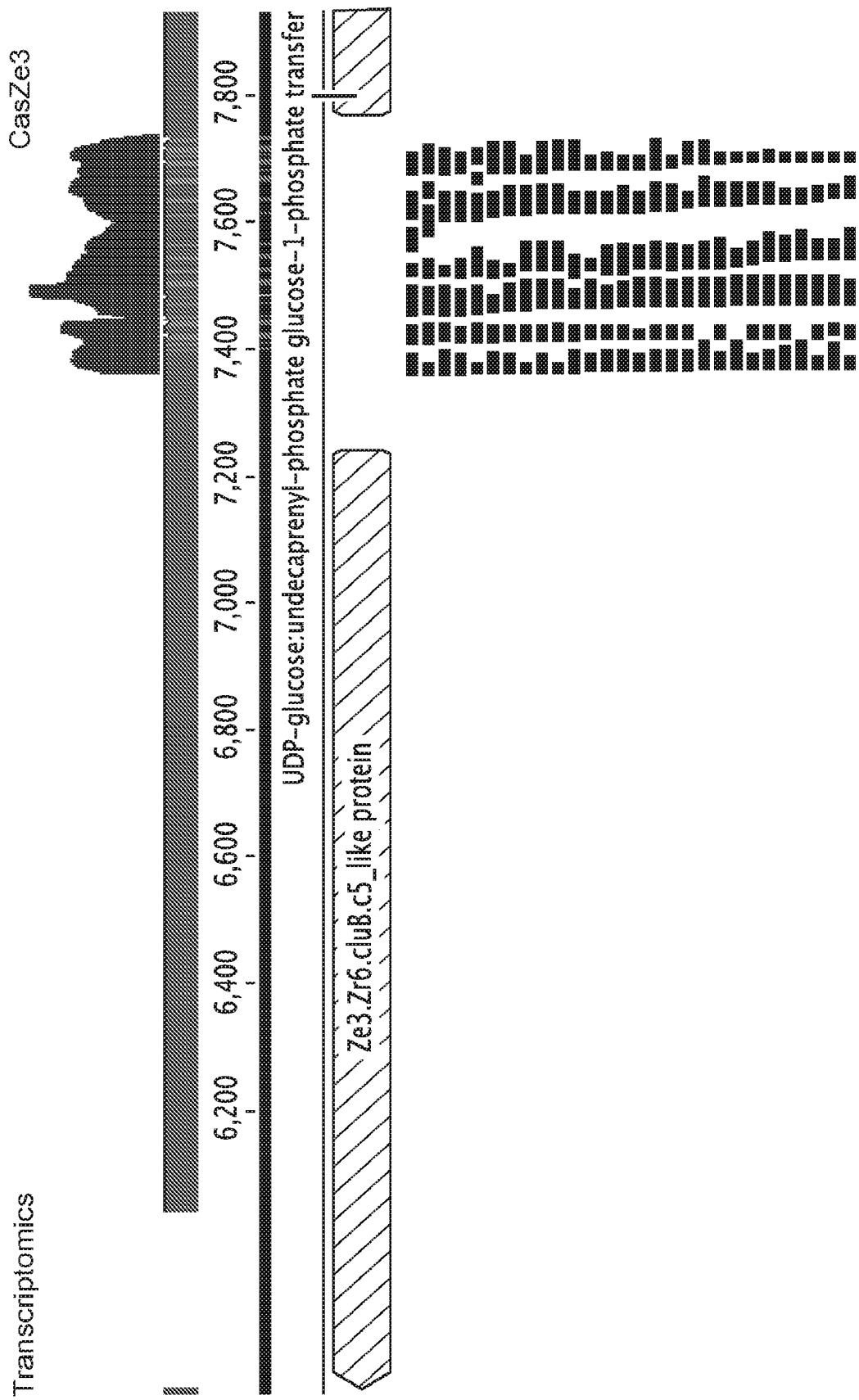

FIG. 21. depicts transcriptoinic RNA mapping data demonstrating expression of trancRNA from CasZ loci. The trancRNAs are adjacent to the CasZ repeat array, but do not include the repeat sequence and are not complementary to the repeat sequence. Shown are RNA mapping data for the following loci: CasZa3, CasZb4, CasZc5, CasZd1, and CasZe3 Small repeating aligned arrows represent the repeats of the CRISPR array (indicating the presence of guide RNA-encoding sequence); The peaks outside and adjacent to the repeat arrays represent highly transcribed trancRNAs.

Figure 22:
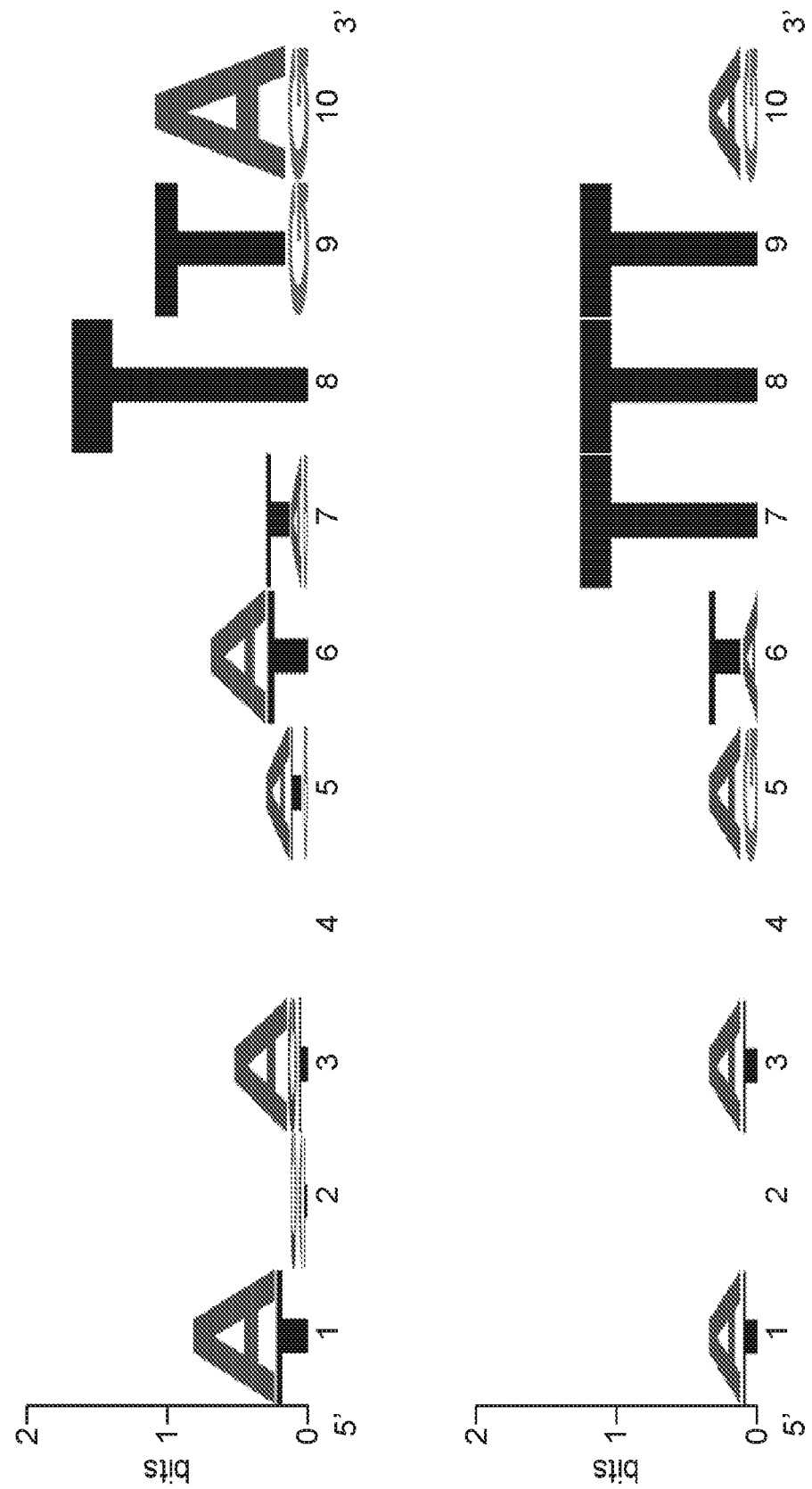

FIG. 22. depicts results for PAM preferences as assayed using PAM depletion assays for CasZc (top) and CasZb (bottom).

Figure 23:
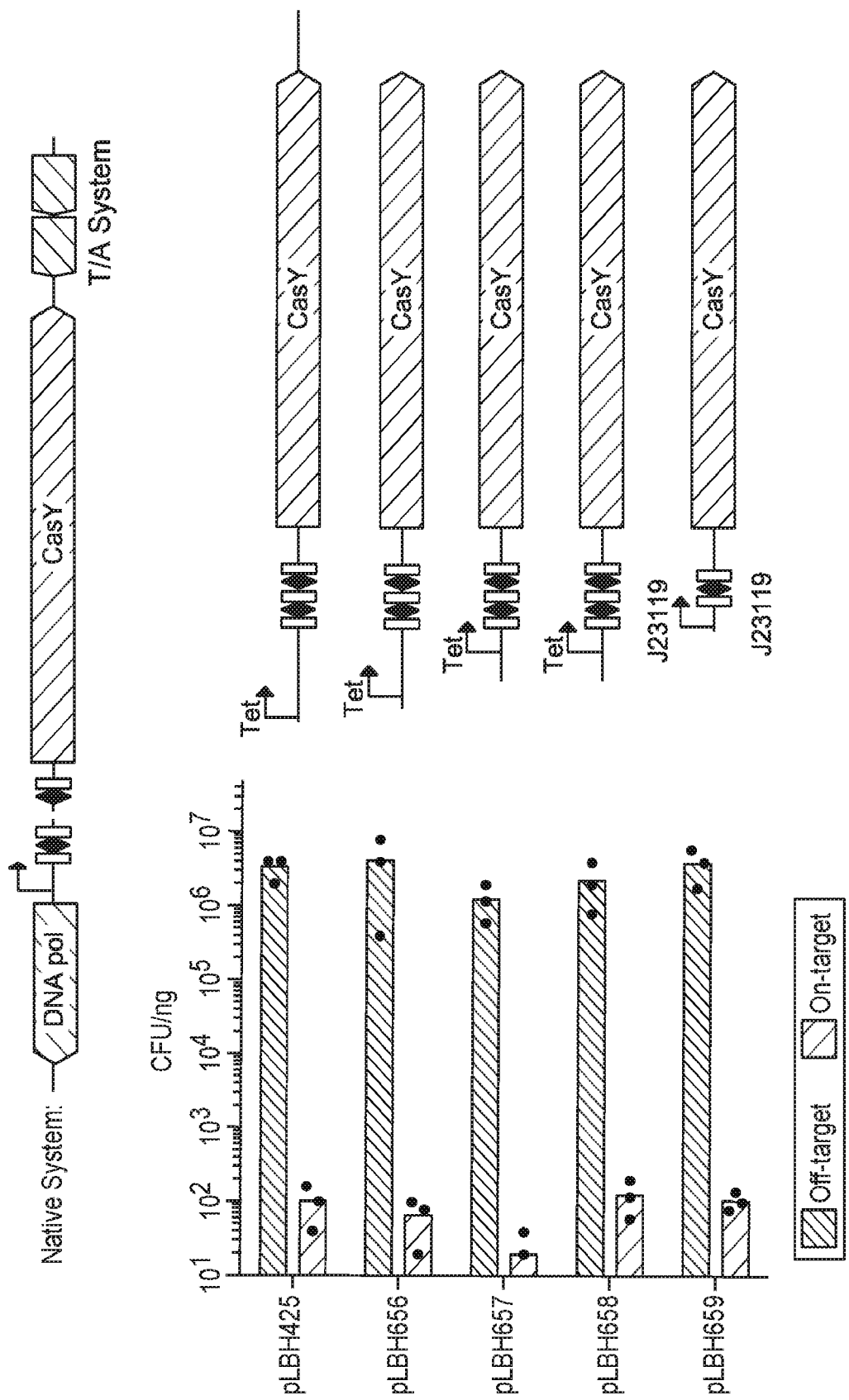
Figure 23:
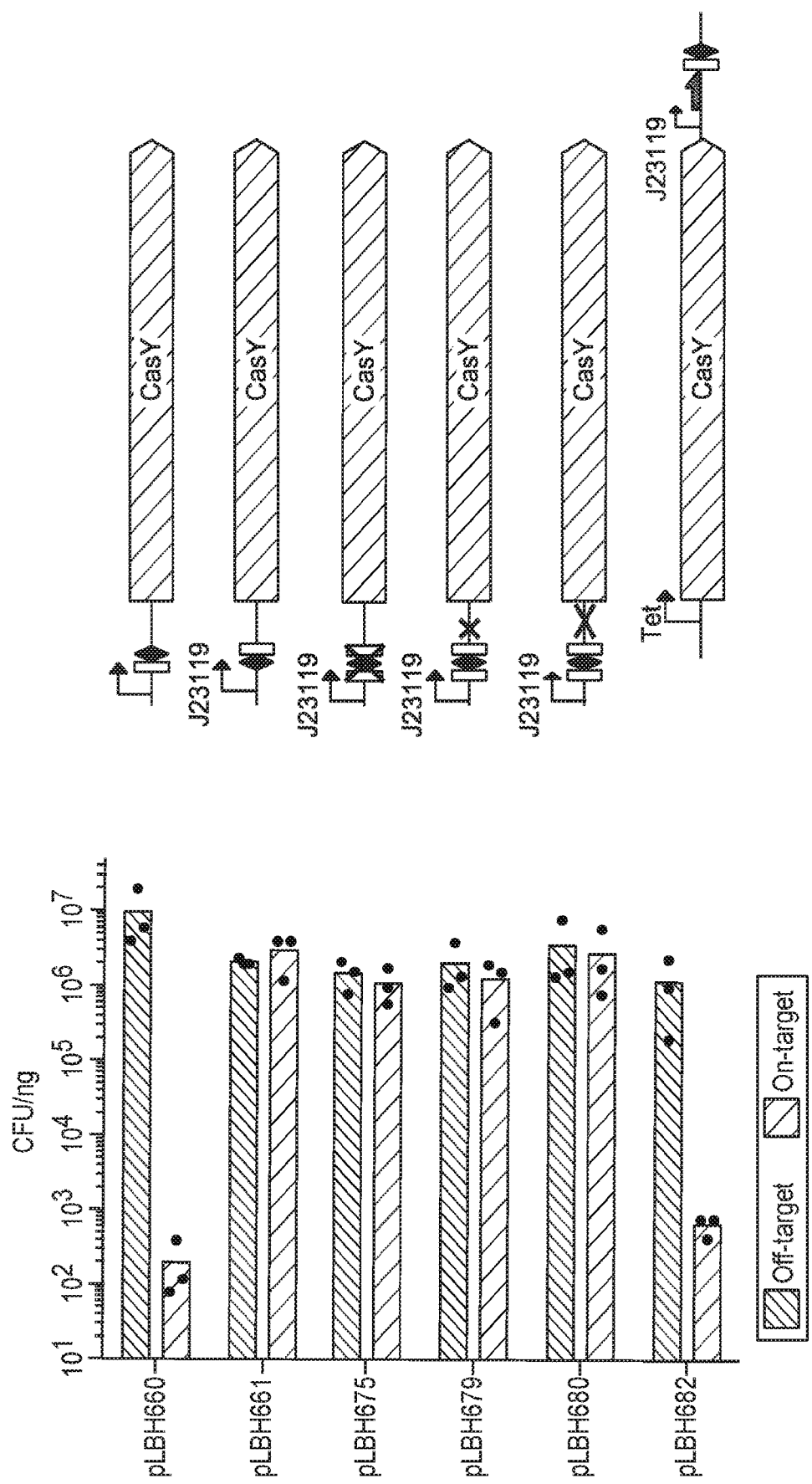

FIG. 23 depicts a plasmid interference assay containing a CRISPR loci plasmid of the present invention.

Figure 24:
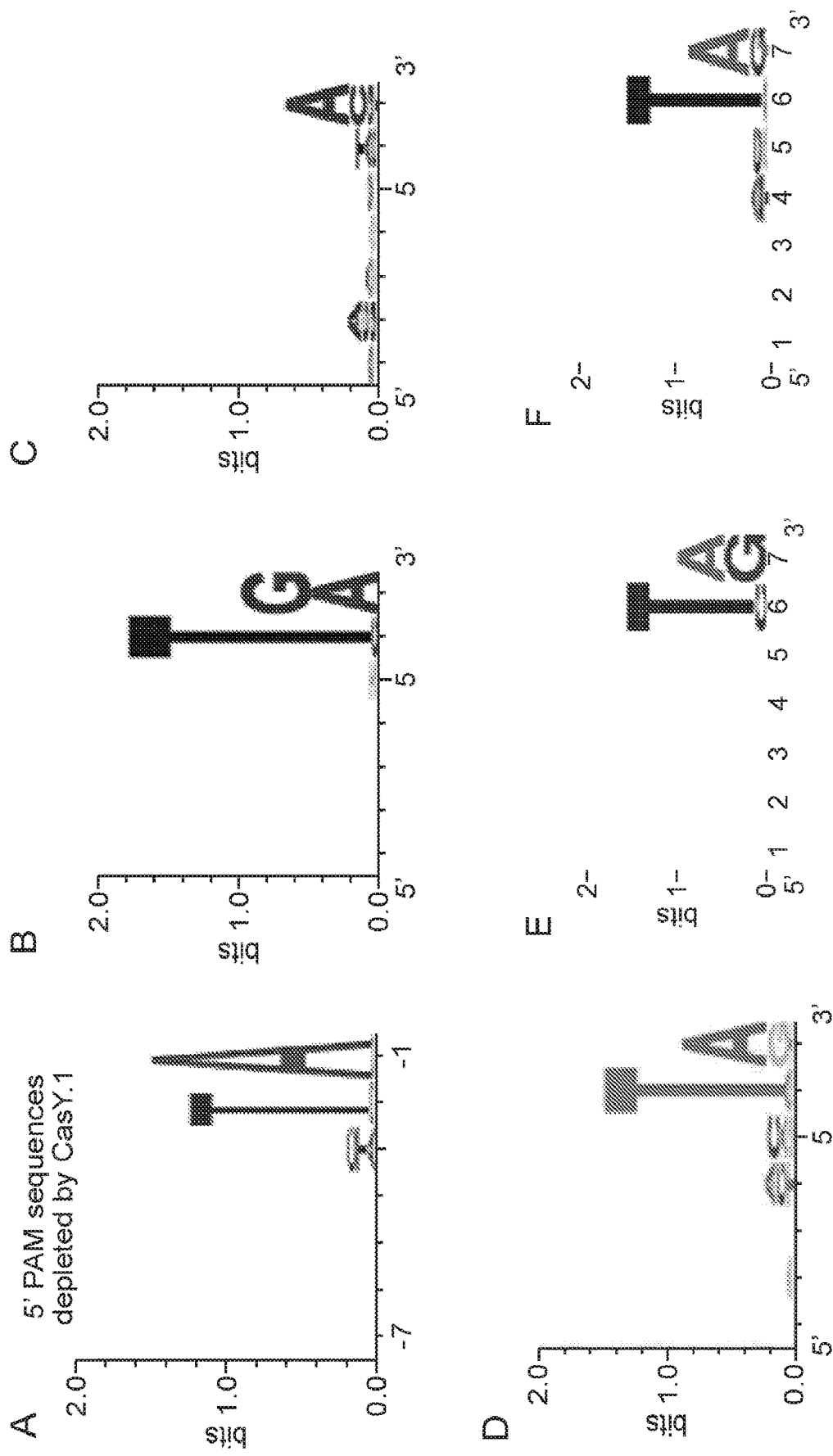

FIG. 24, Panels A-F PAM-dependent plasmid interference assays that show PAM depletion to determine a PAM sequence for CasY orthologs (FIG. 24, Panel A:CasY1, FIG. 24, Panel B:CasY15, FIG. 24, Panel C: CasY10, FIG. 24, Panel D: CasY3, FIG. 24, Panel E: CasY11; and FIG. 24, Panel F: C2c3_1).

Figure 25:
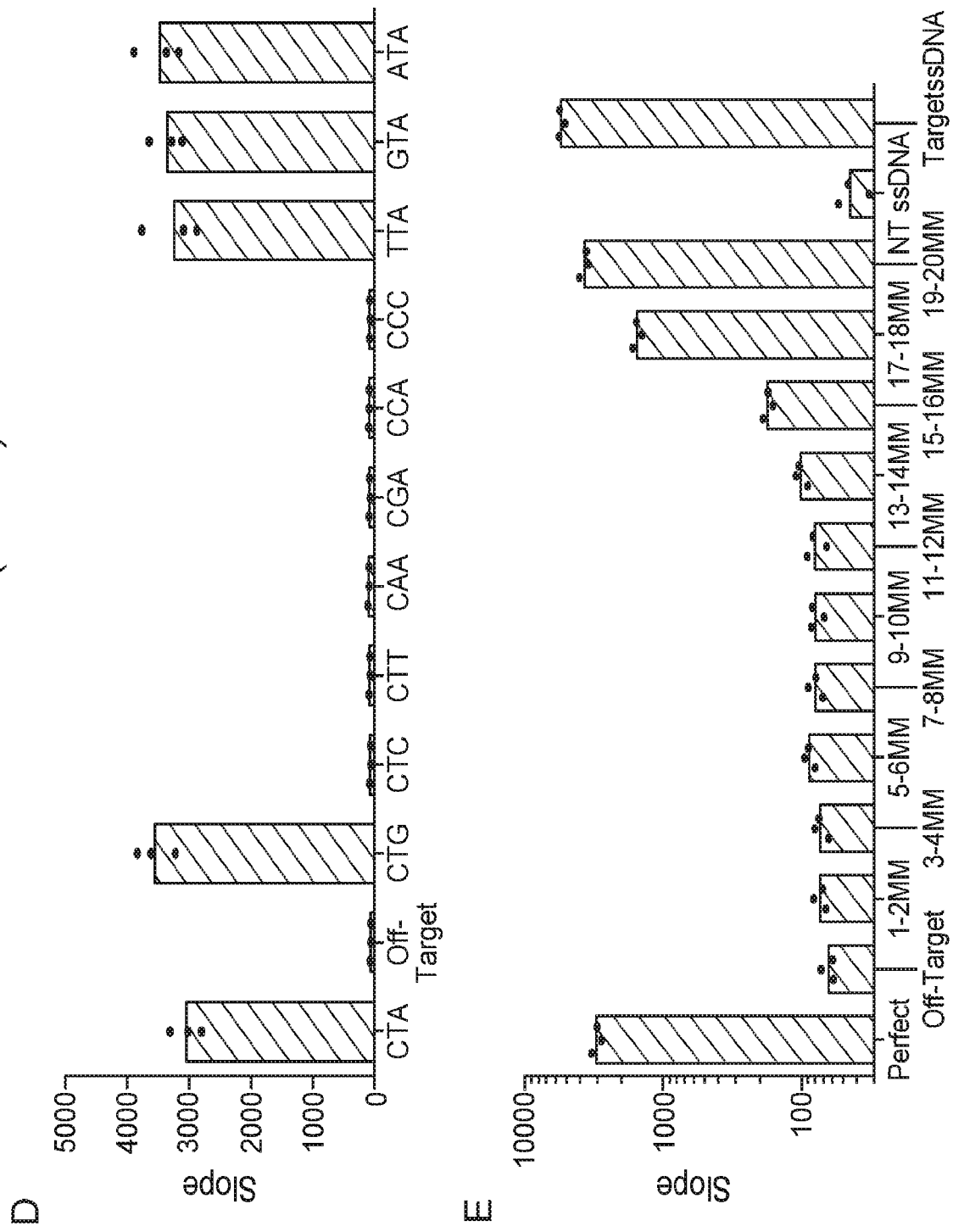

FIG. 25, Panels A-E depict CasY15 trans cleavage assays with various RNA components, PAM sequences, and mismatch tolerance.

FIG. 26 depicts Table 3 of CasY15 RNA sequences.

FIG. 27 depicts Table 4 of CasY15 DNA sequences.

Figure 28:
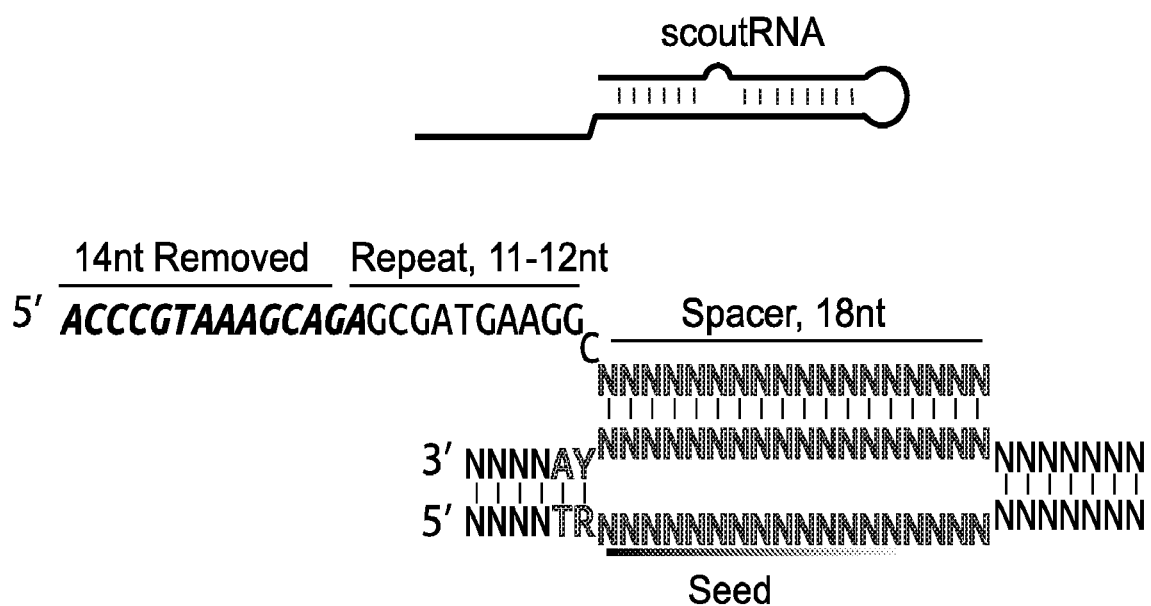

FIG. 28 depicts a model of CasY interference complex and RNA.

FIG. 29 depict the sequences of Cas14 proteins described herein.

FIG. 30, Panels A-D depict the architecture and phylogeny of CRISPR-Cas14 genomic loci.

Figure 31:
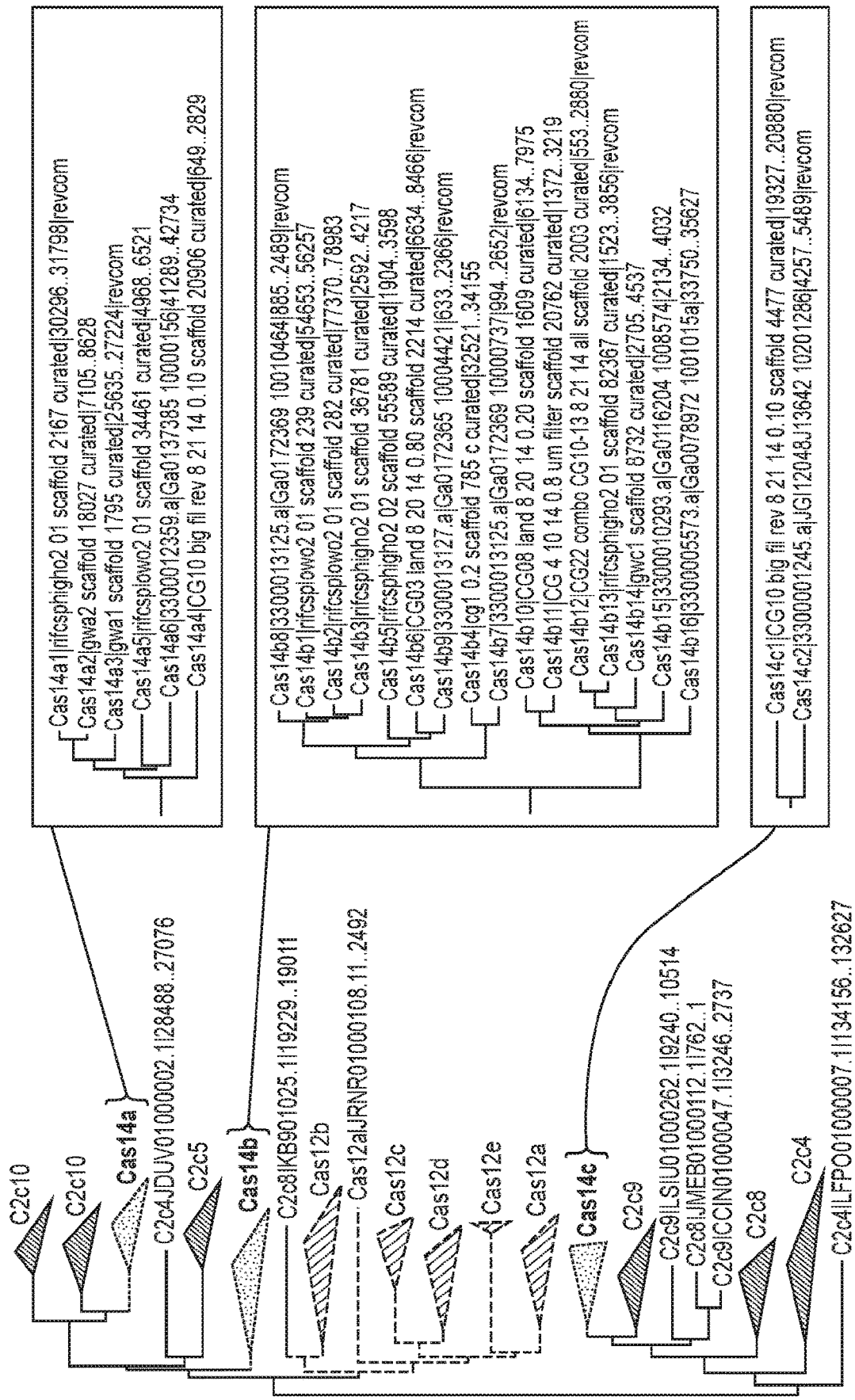

FIG. 31 depicts a phylogenetic analysis of Cas14 orthologs.

Figure 32:
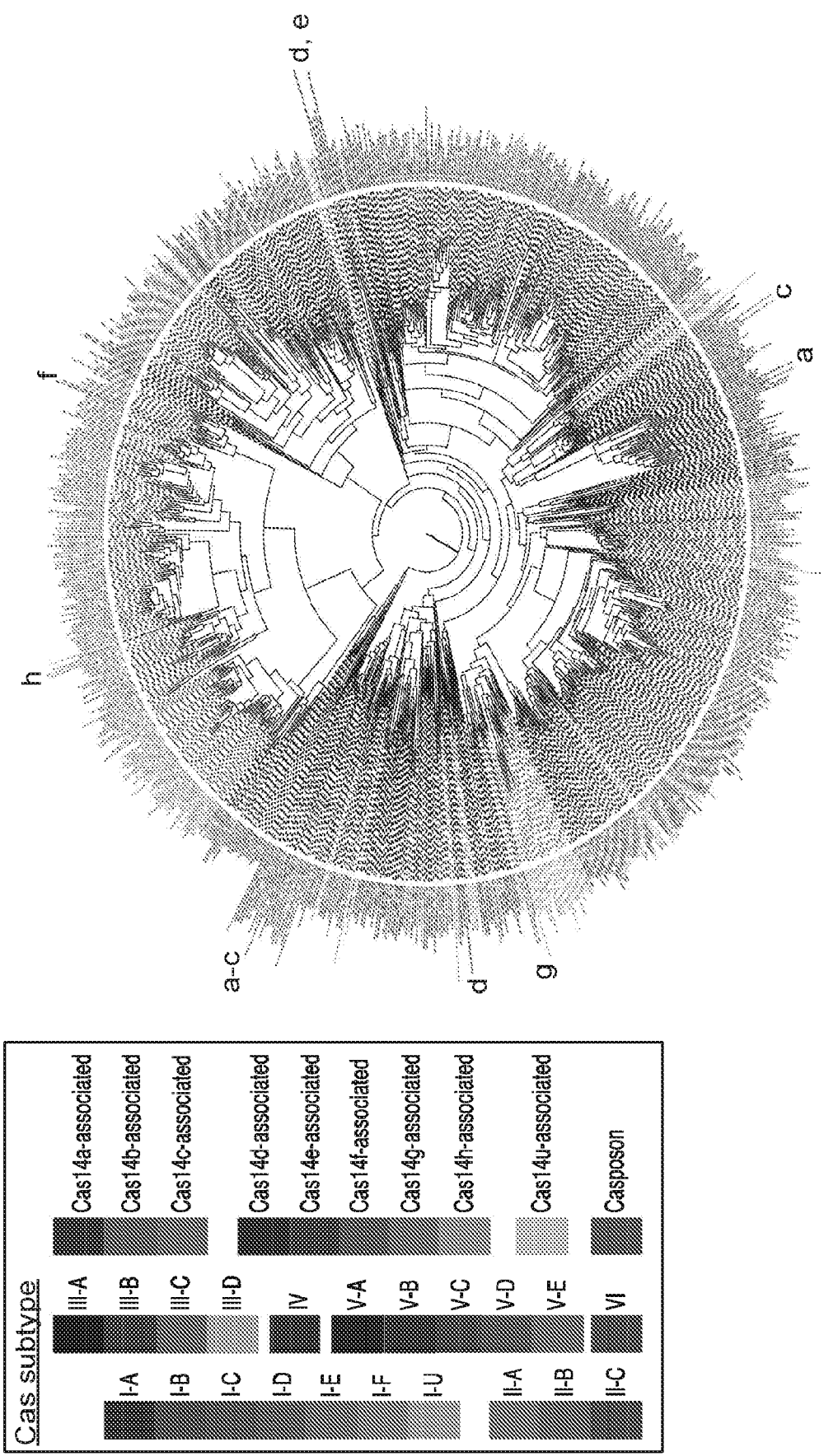

FIG. 32 depicts a maximum likelihood tree for Cas1 from known CRISPR systems.

Figure 33:
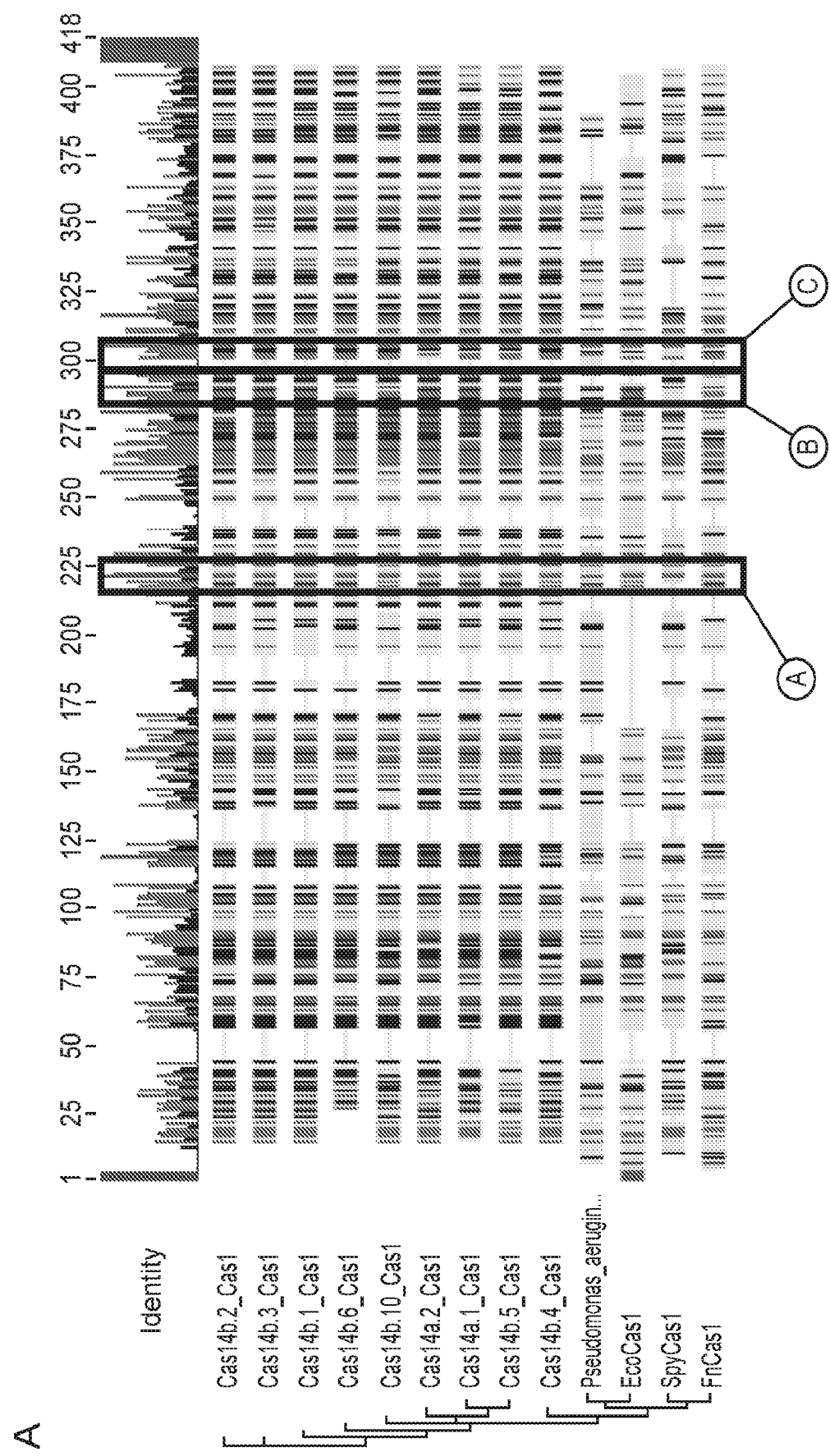
Figure 33:
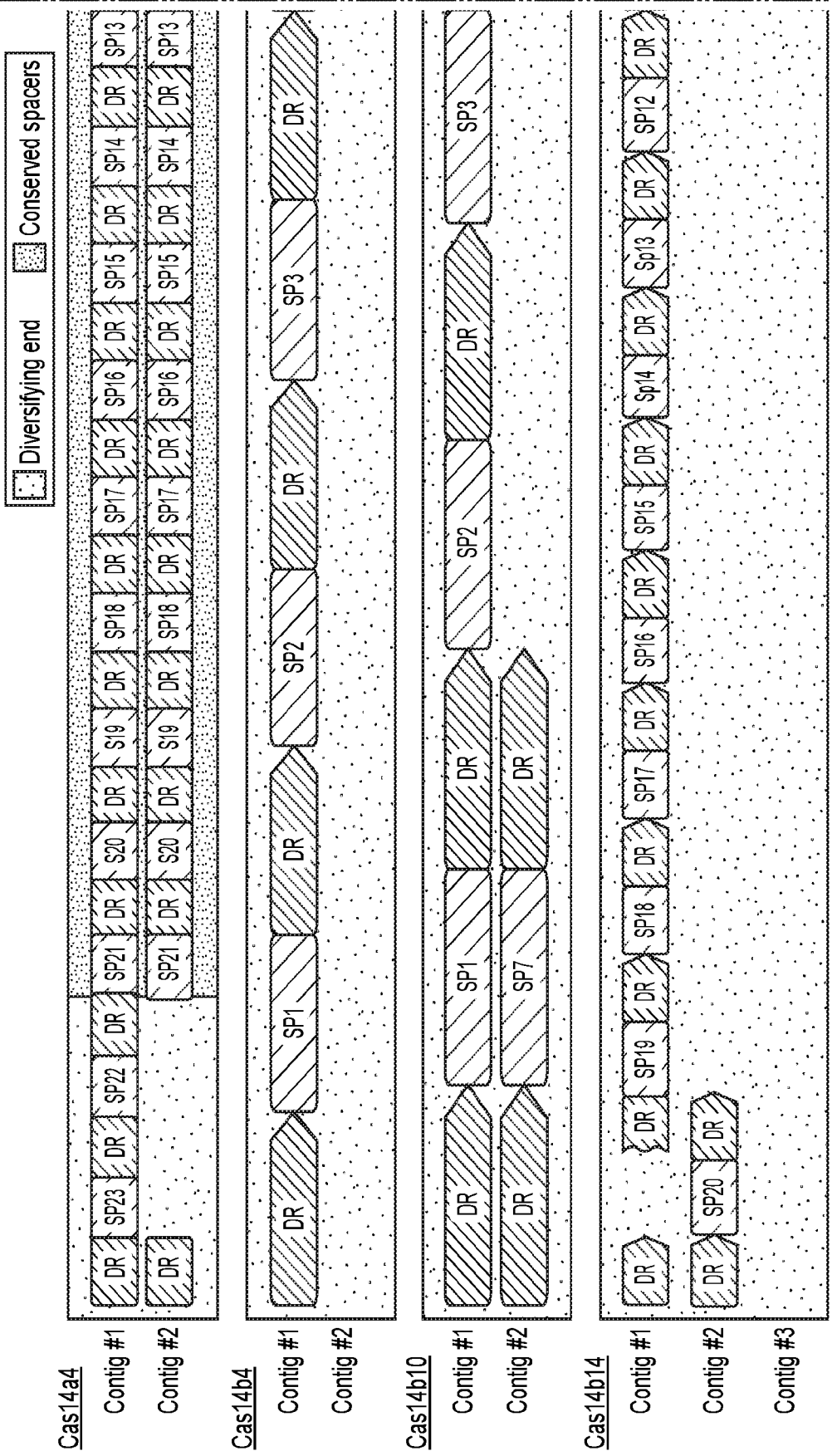
Figure 33:
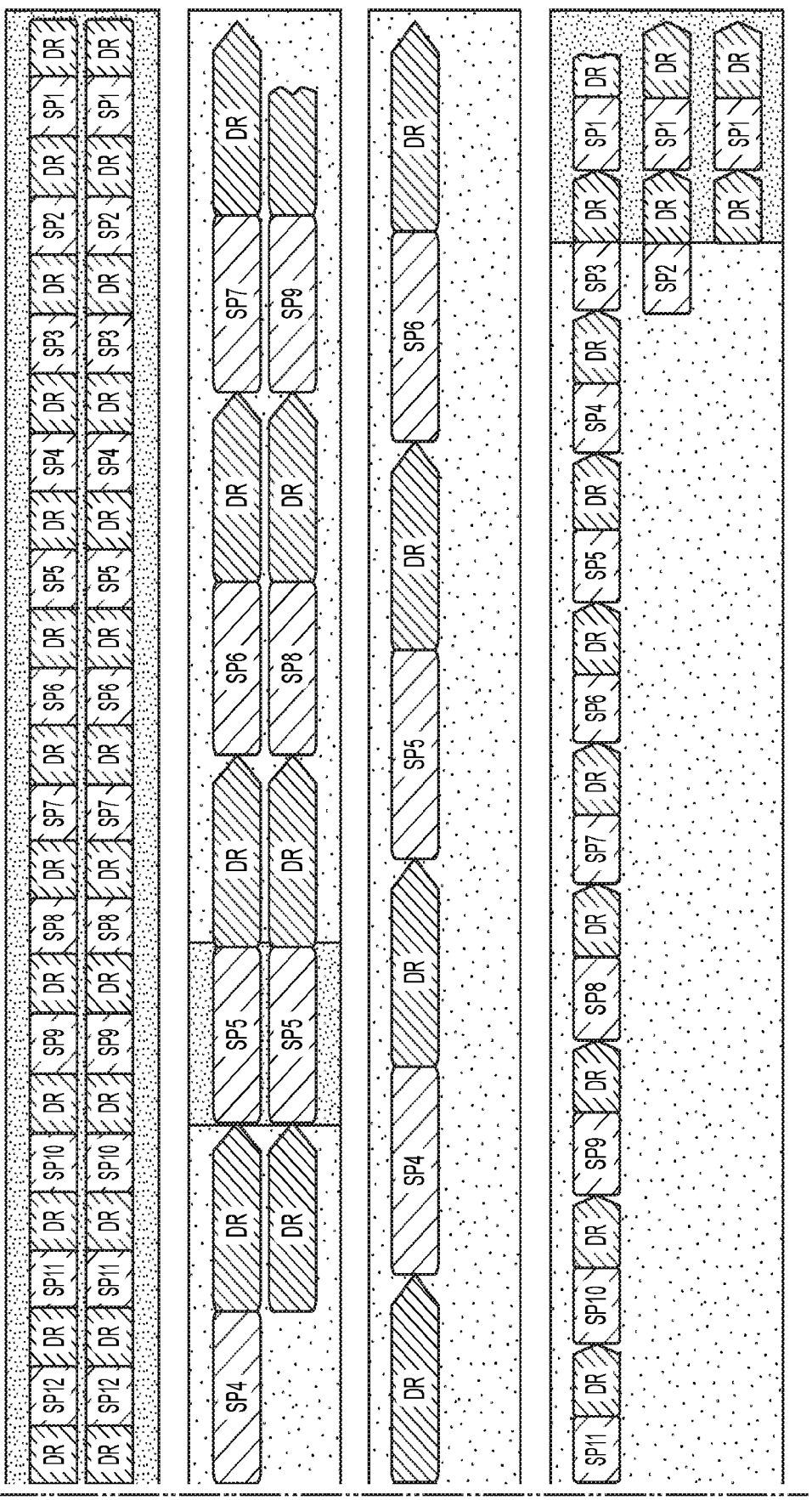

FIG. 33, Panels A-B depict the acquisition of new spacers by CRISPR-Cas14 systems.

Figure 34:
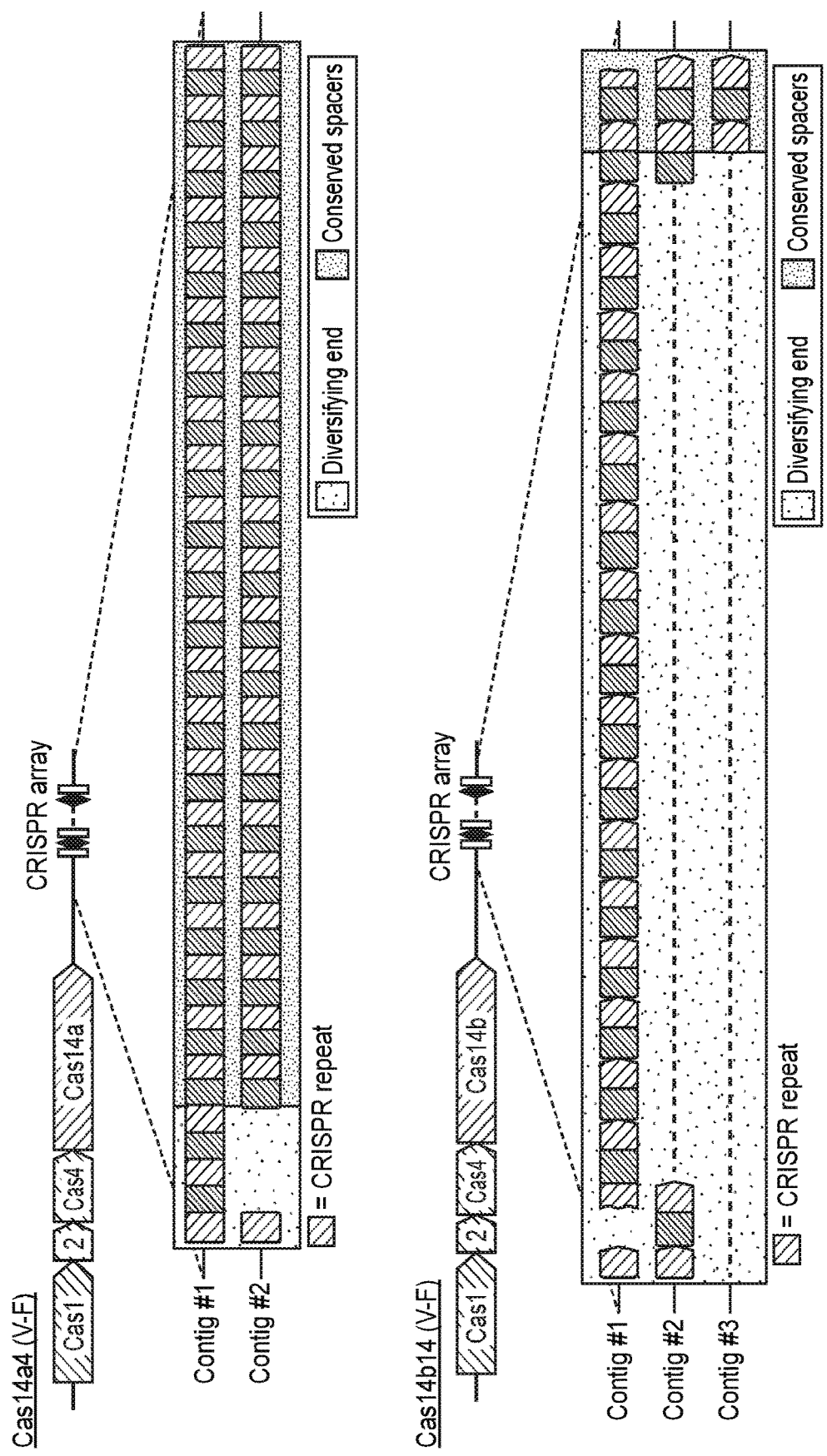
Figure 34:
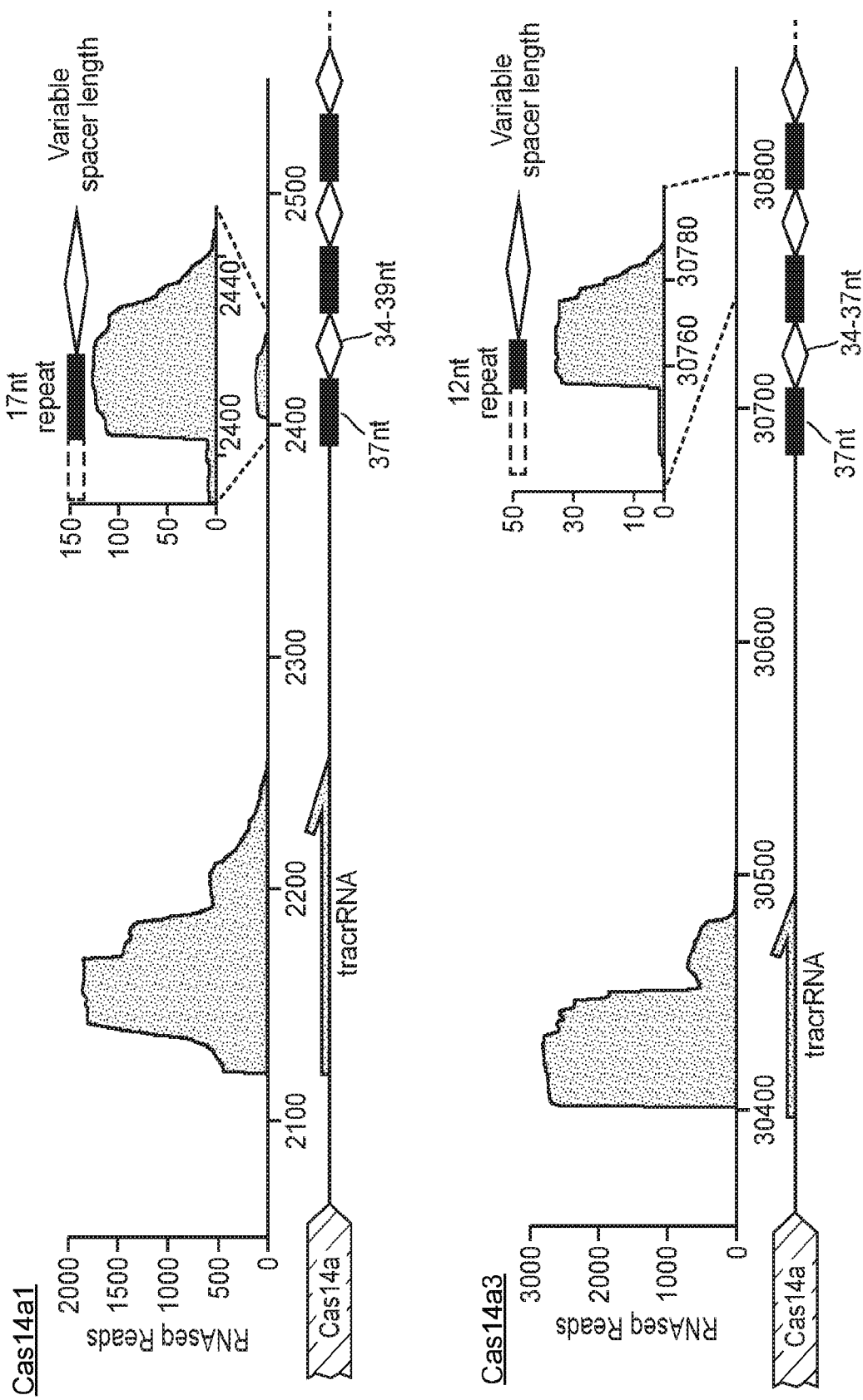

FIG. 34, Panels A-D depict that CRISPR-Cas14a actively adapts and encodes a tracrRNA.

Figure 35:
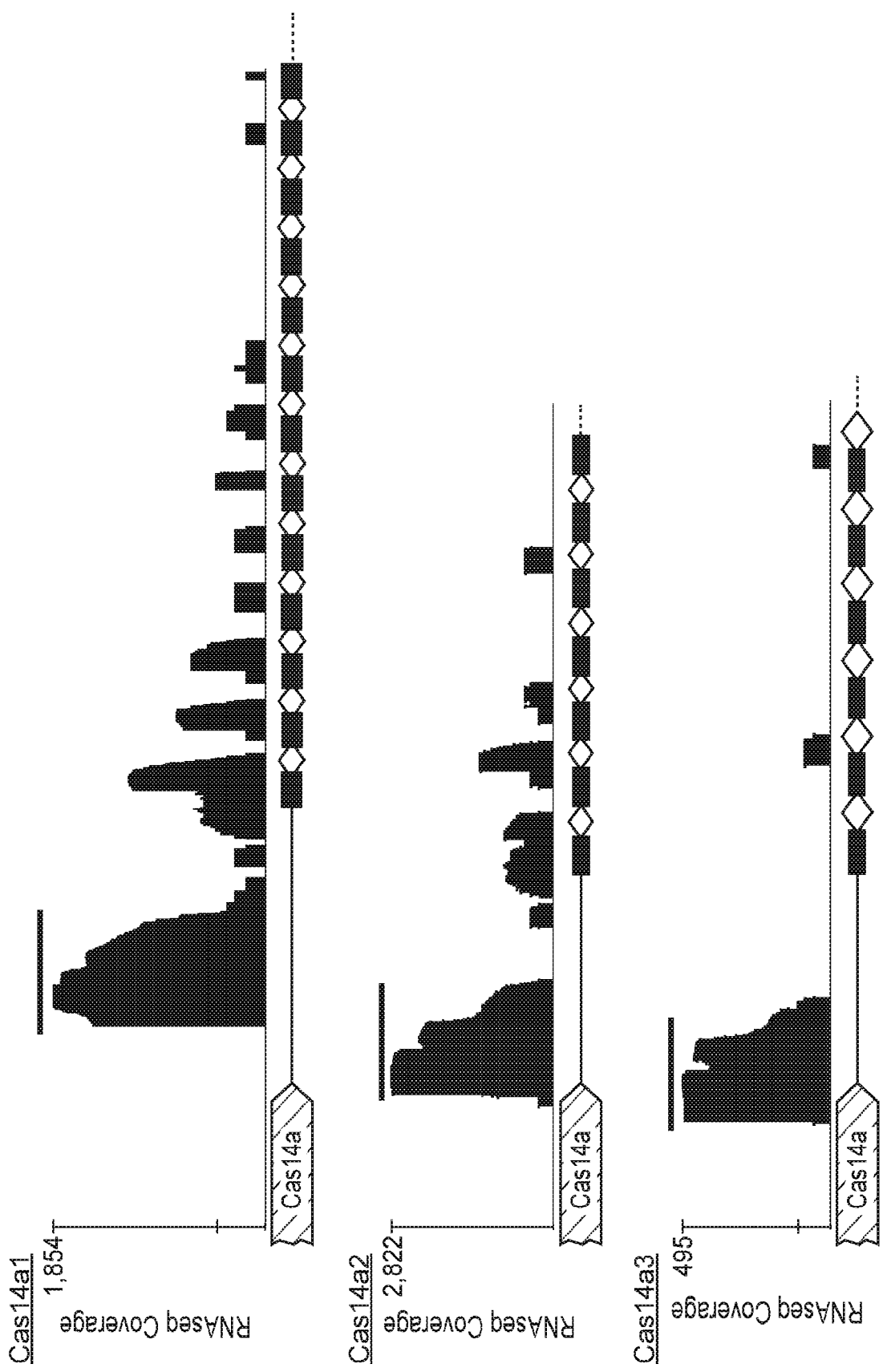
Figure 35:
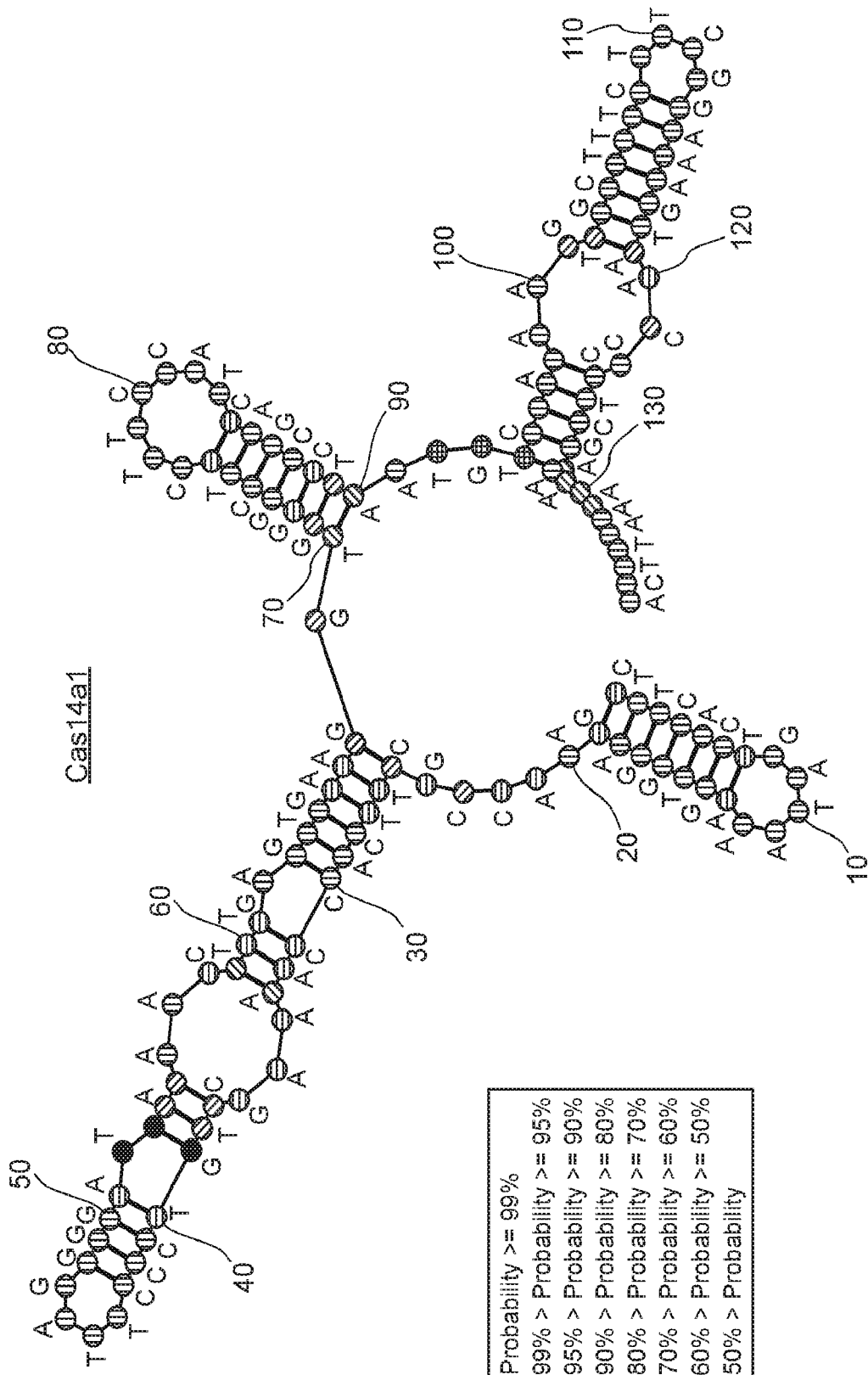
Figure 35:
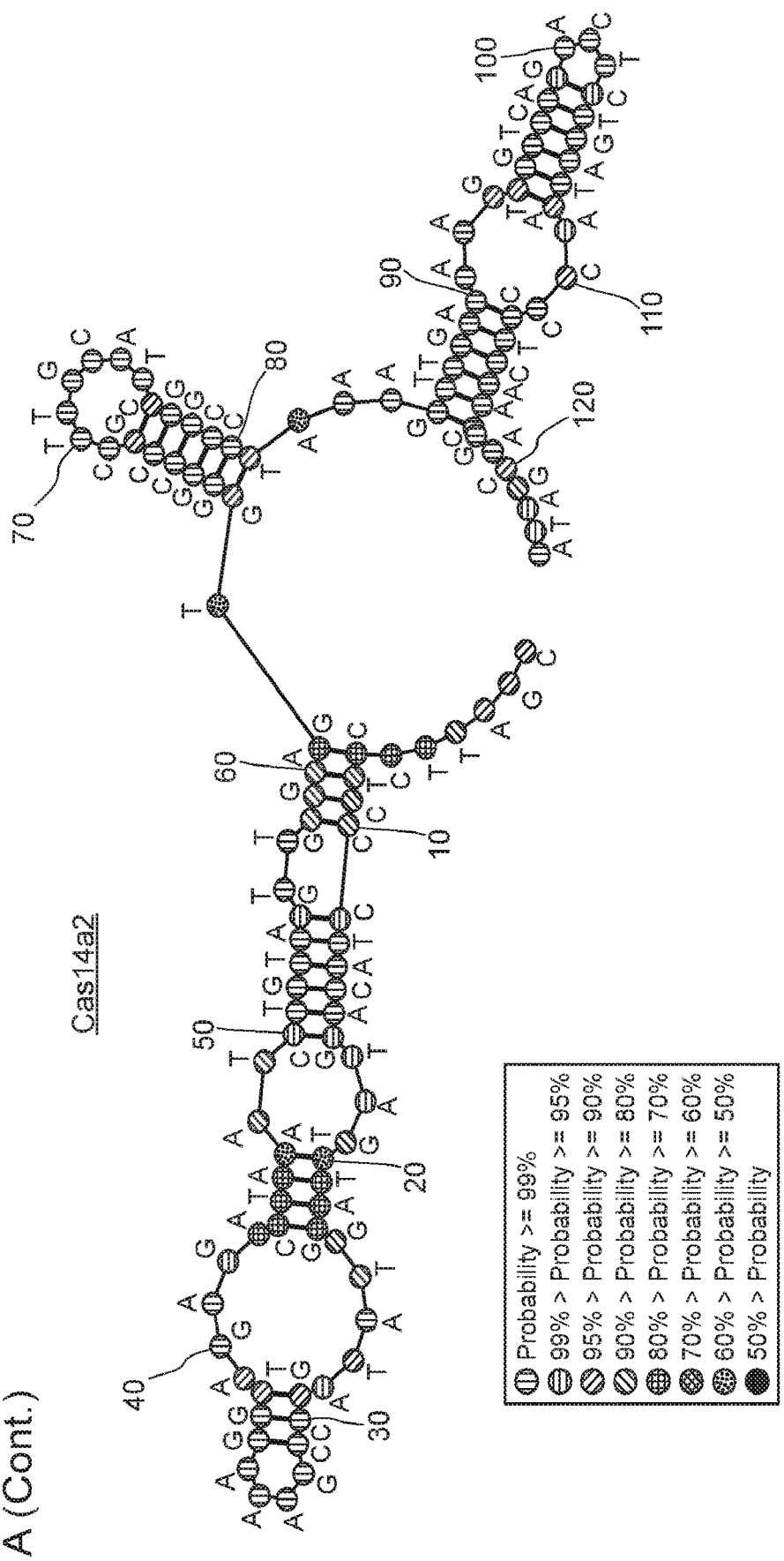
Figure 35:
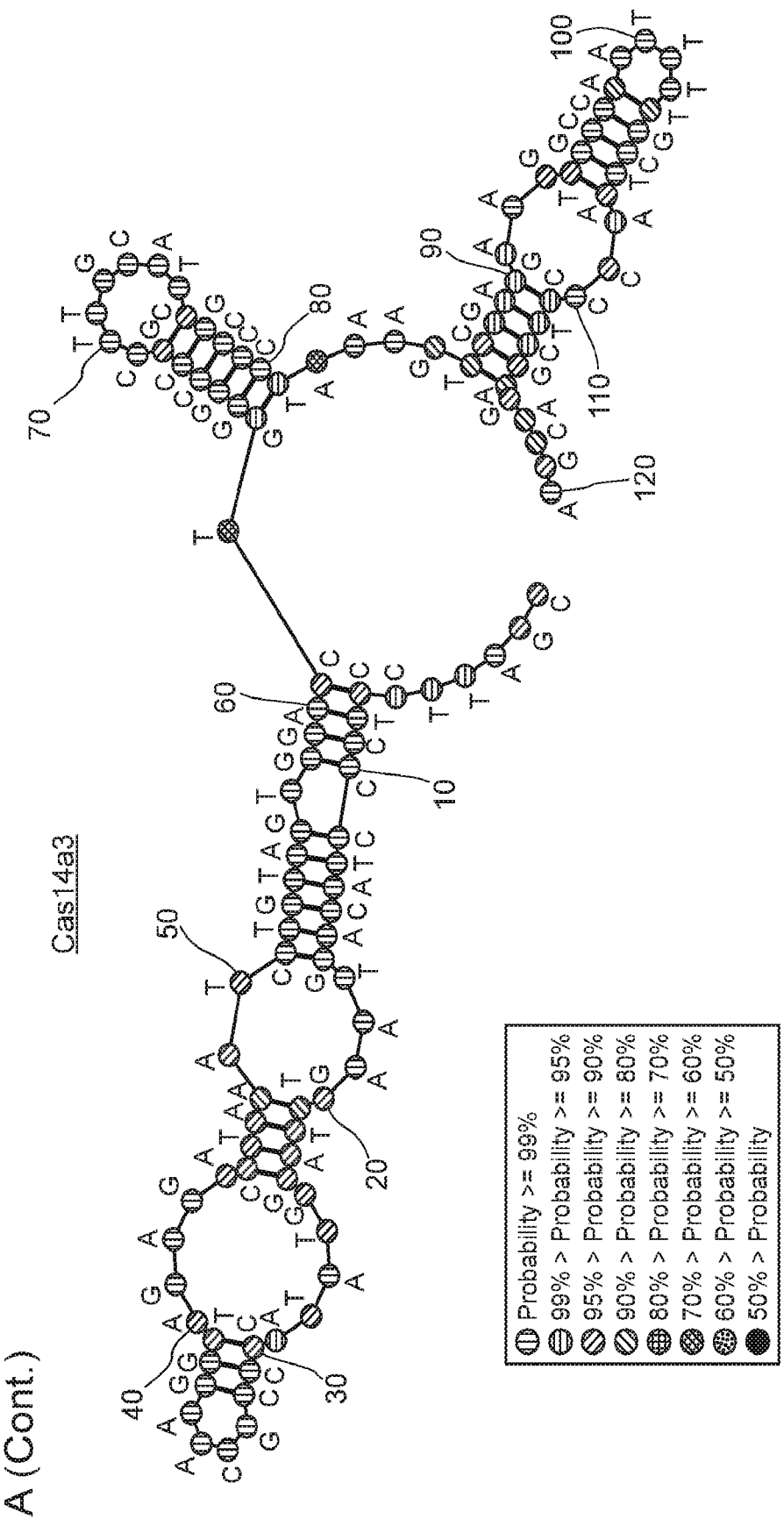

FIG. 35, Panels A-B depict metatranscriptomics for CRISPR-Cas14 loci.

Figure 36:
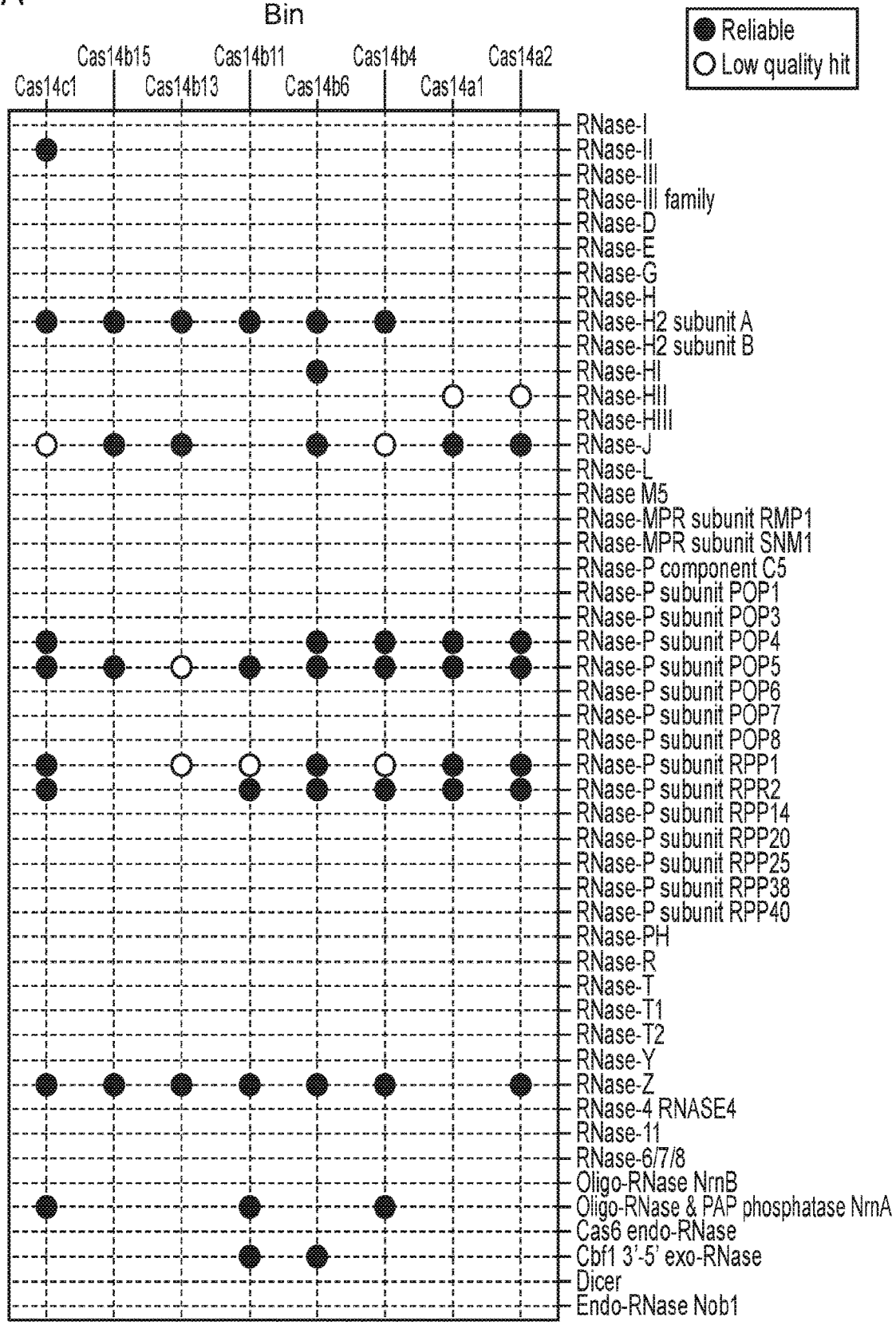

FIG. 36, Panels A-B depict RNA processing and heterologous expression by CRISPR-Cas14.

Figure 37:
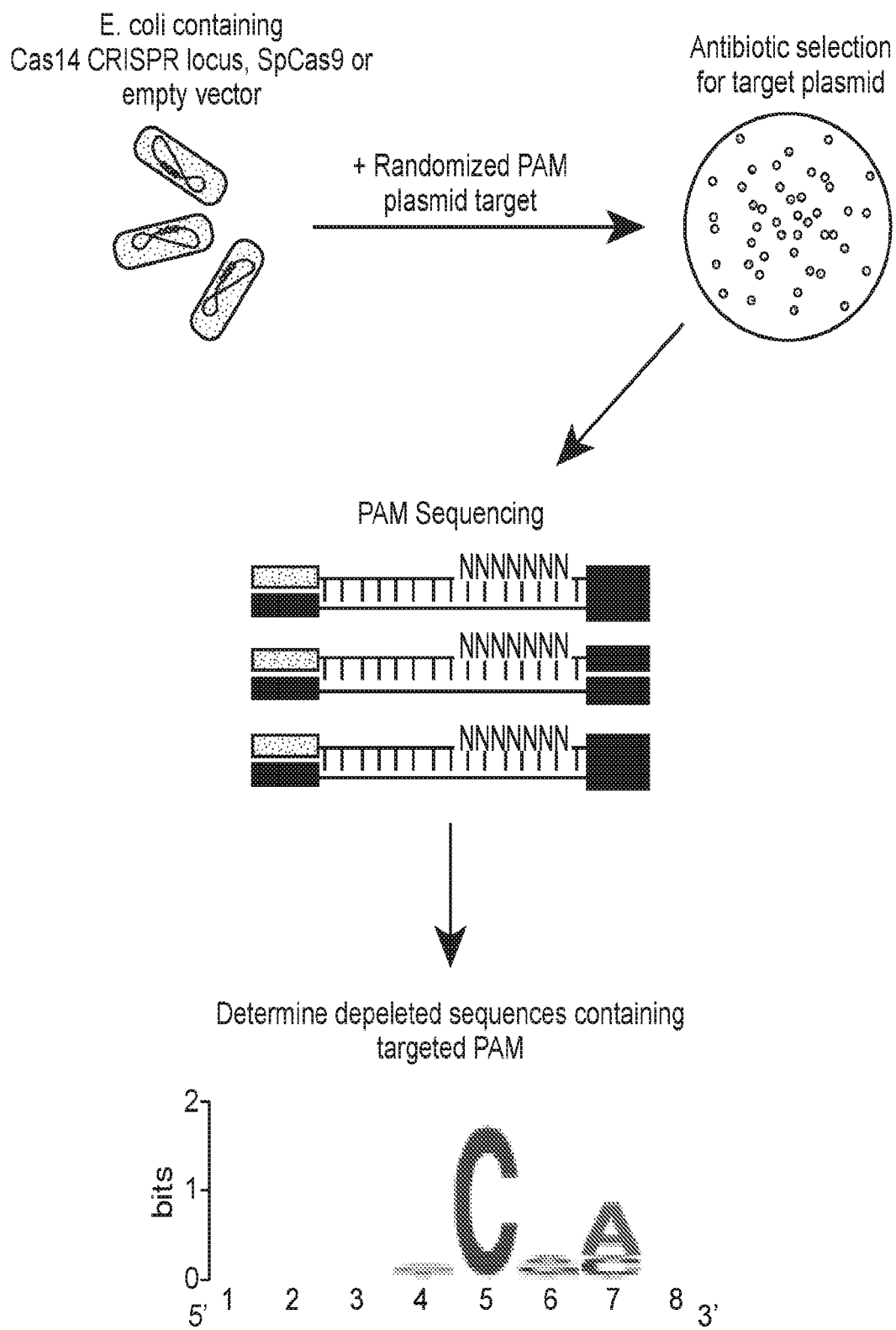
Figure 37:
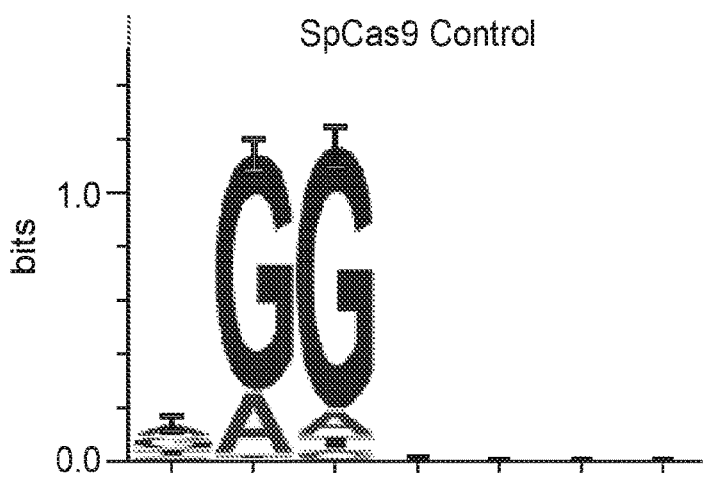

FIG. 37, Panels A-D depict plasmid depletion by Cas14a1 and SpCas9.

Figure 38:
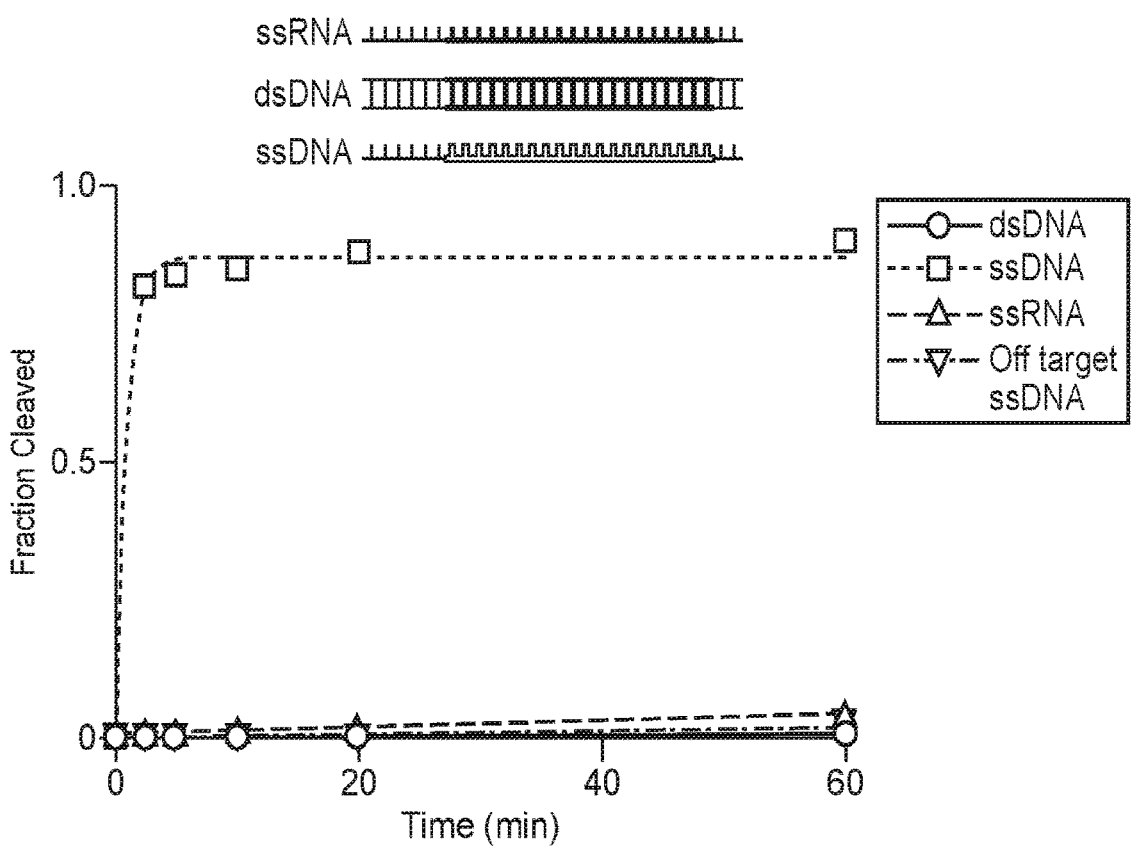
Figure 38:
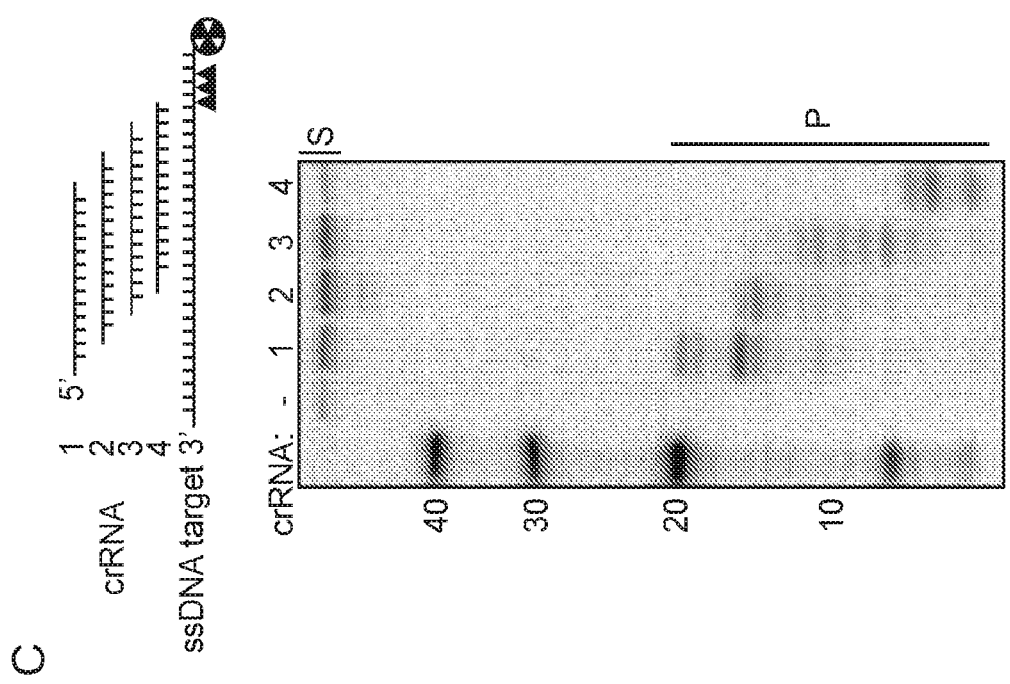

FIG. 38, Panels A-D depict CRISPR-Cas14a is an RNA-guided DNA-endonuclease.

Figure 39:
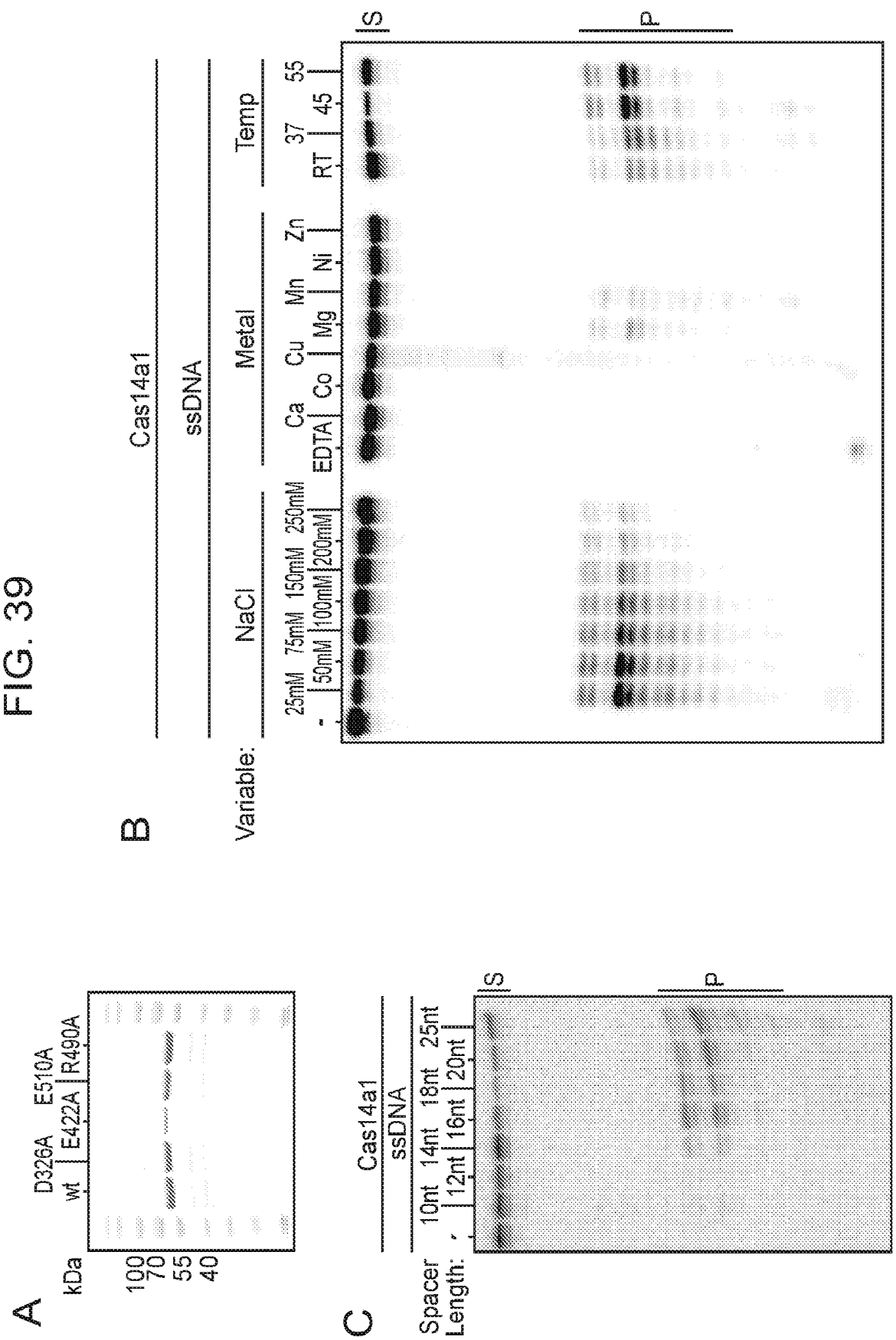
Figure 39:
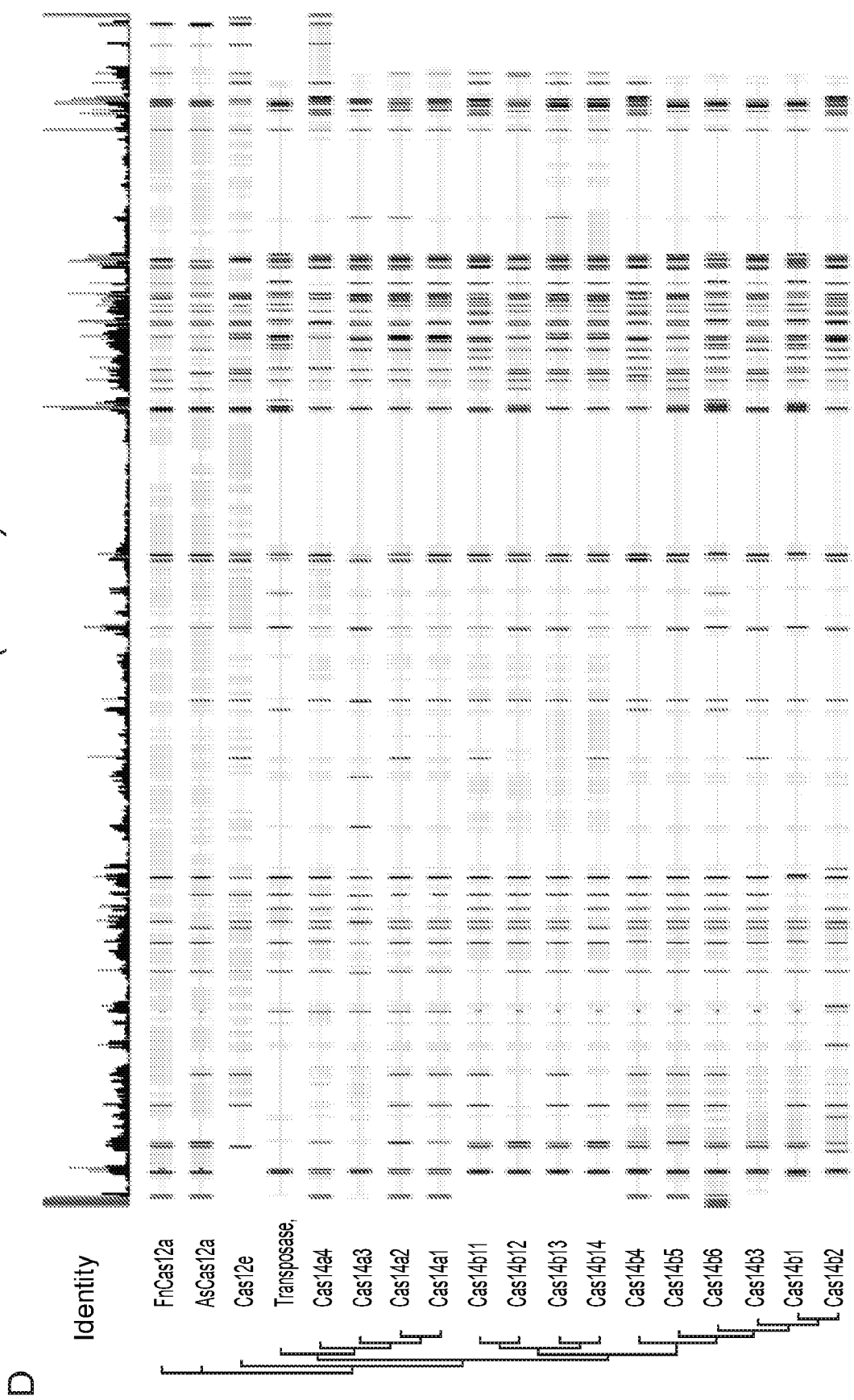
Figure 39:
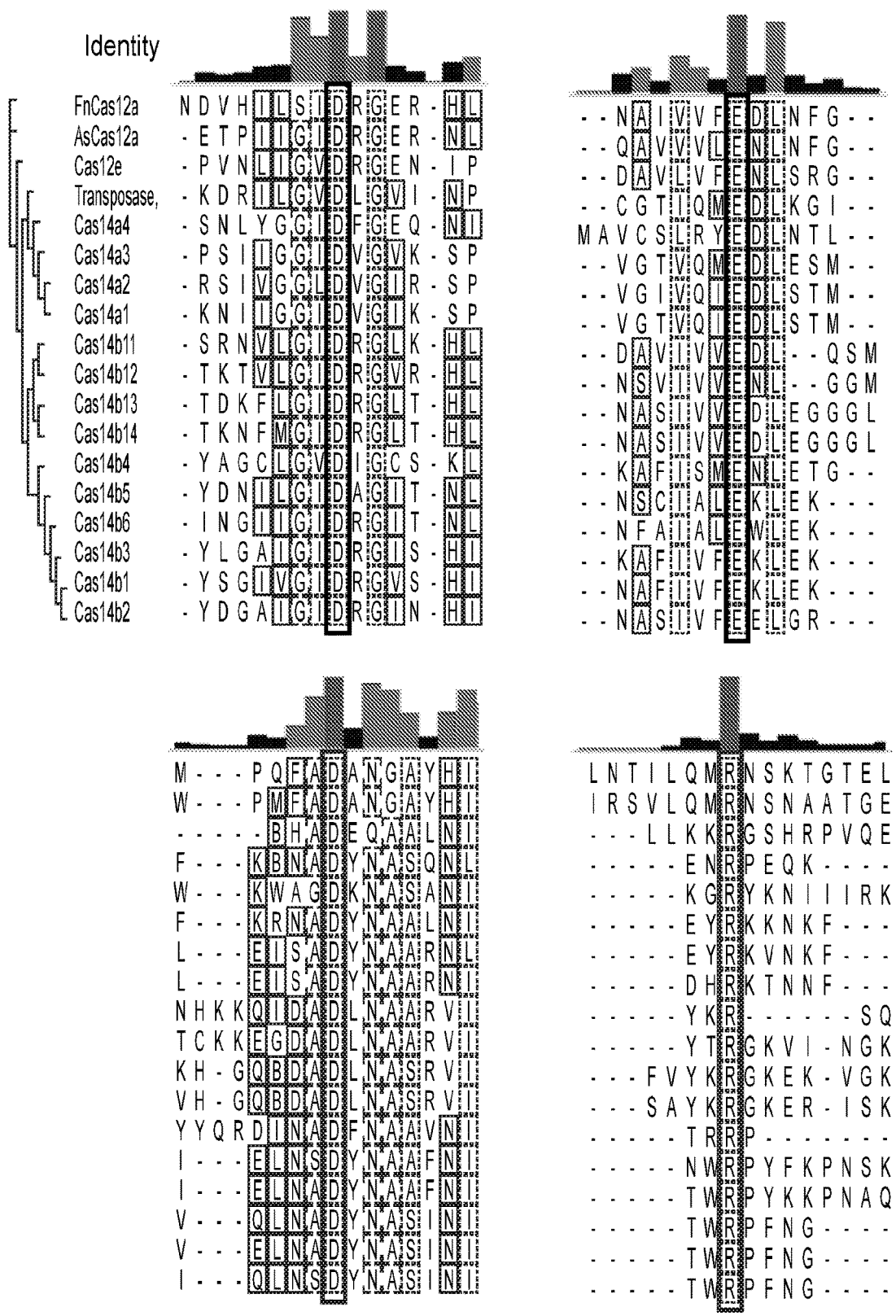

FIG. 39, Panels A-E depict degradation of ssDNA by Cas14a1.

Figure 40:
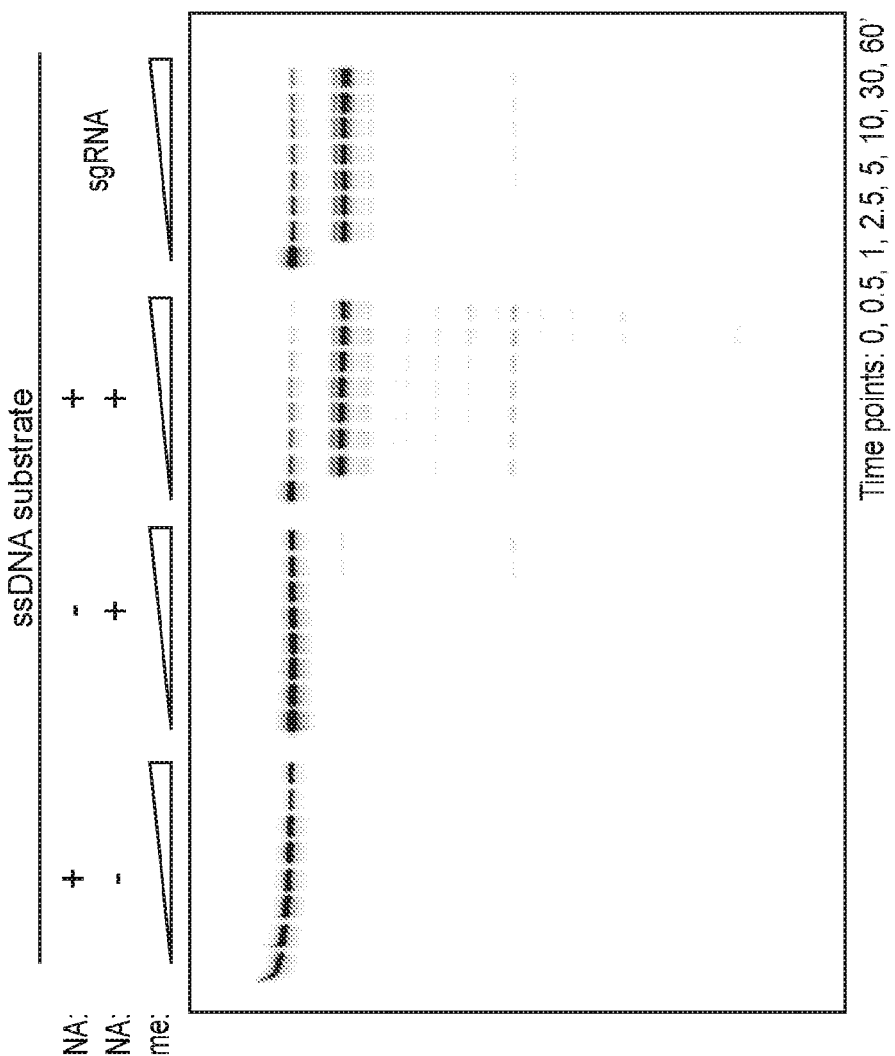
Figure 39:
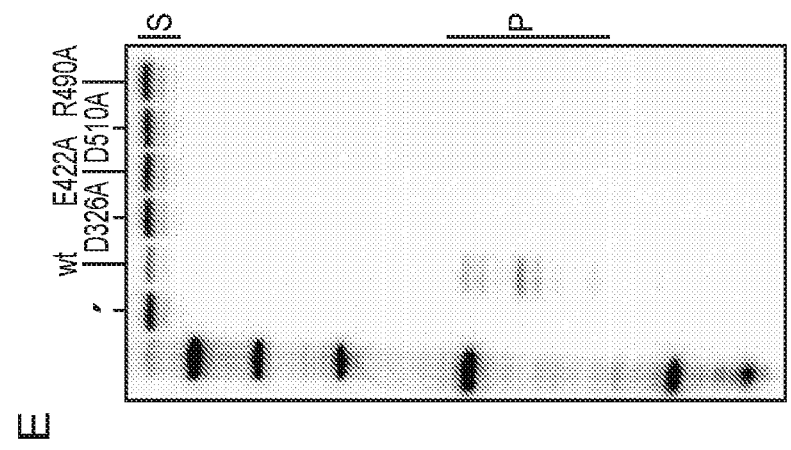

FIG. 40 depicts kinetics of Cas14a1 cleavage of ssDNA with various guide RNA components.

Figure 41:
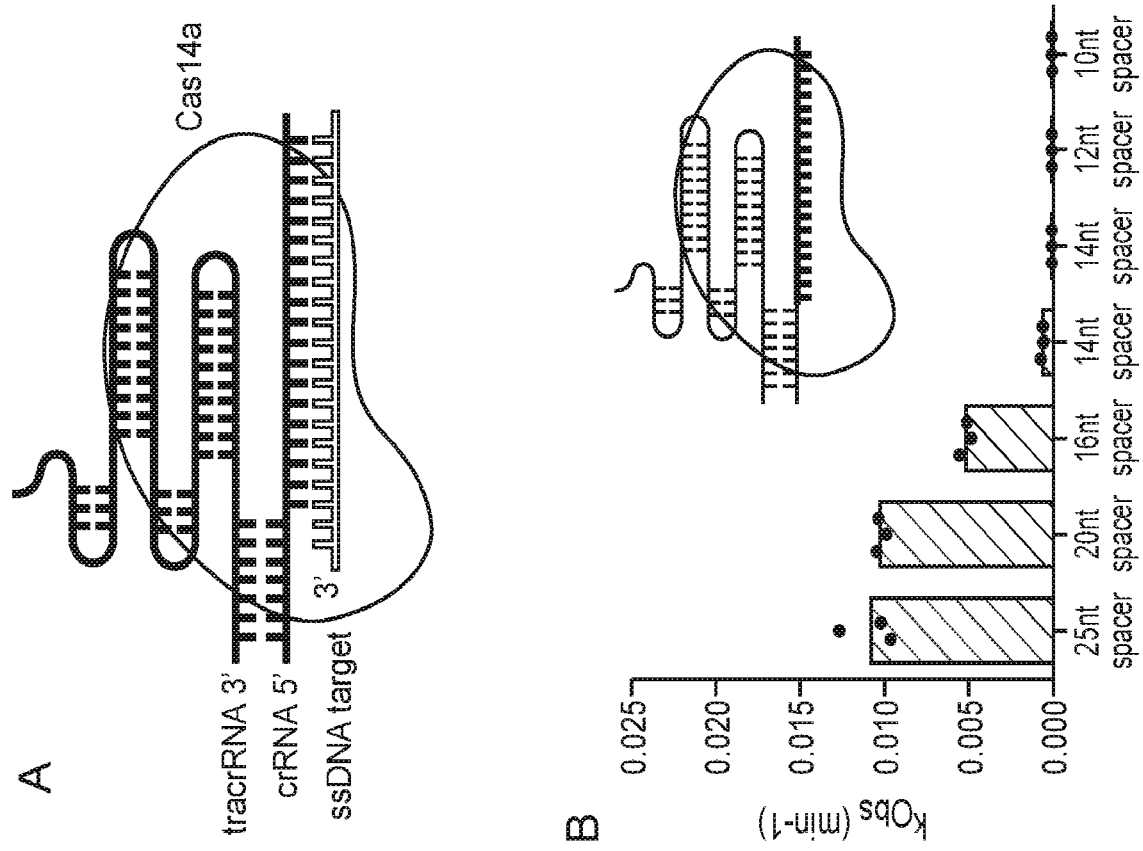

FIG. 41, Panels A-F depict optimization of Cas14a1 guide RNA components.

Figure 42:
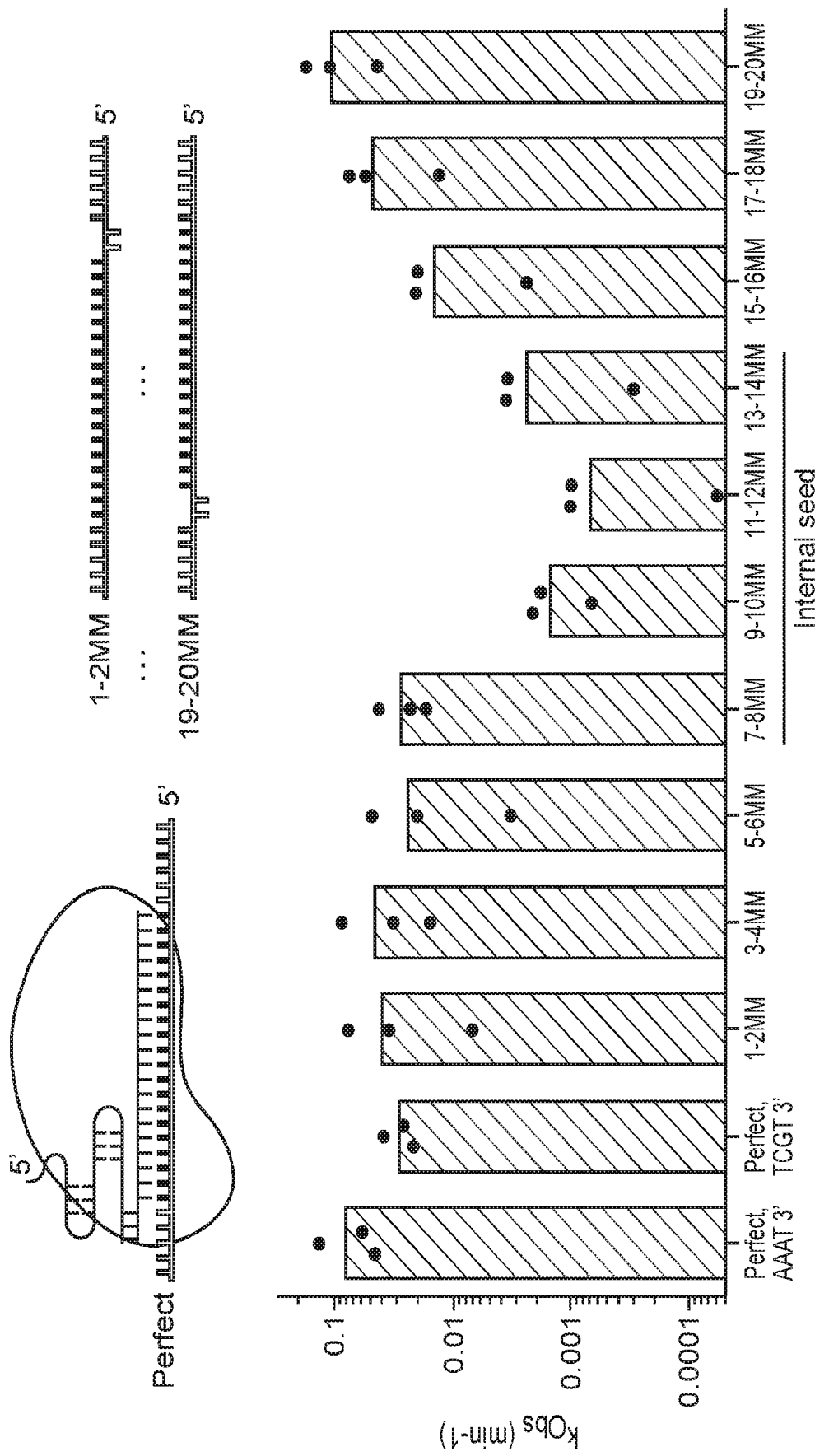
Figure 42:
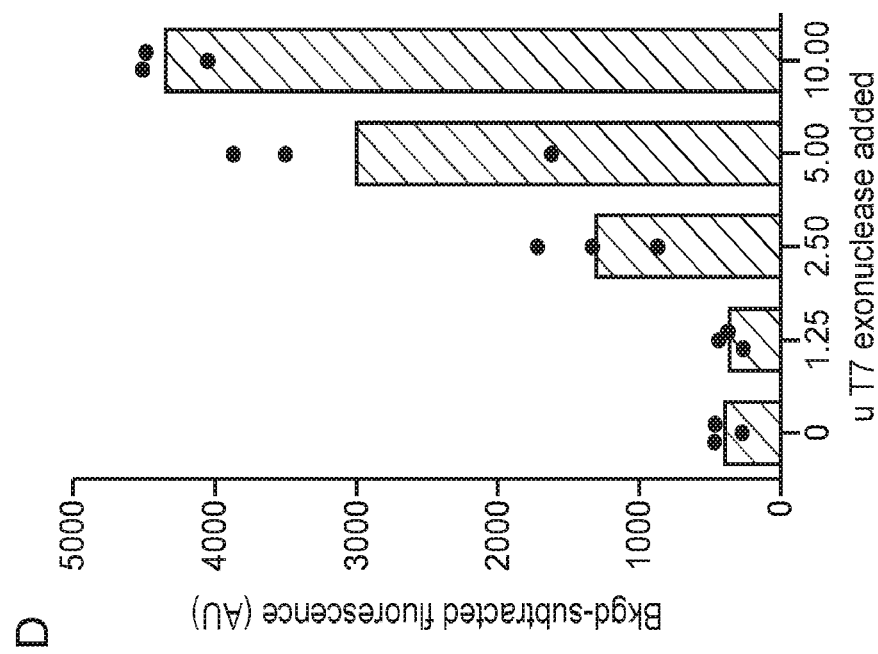

FIG. 42, Panels A-E depict high fidelity ssDNA DNP detection by CRISPR-Cas14a.

FIG. 42, panel C provides nucleotide sequences (Top to Bottom: SEQ ID NOs:498-500)

Figure 43:
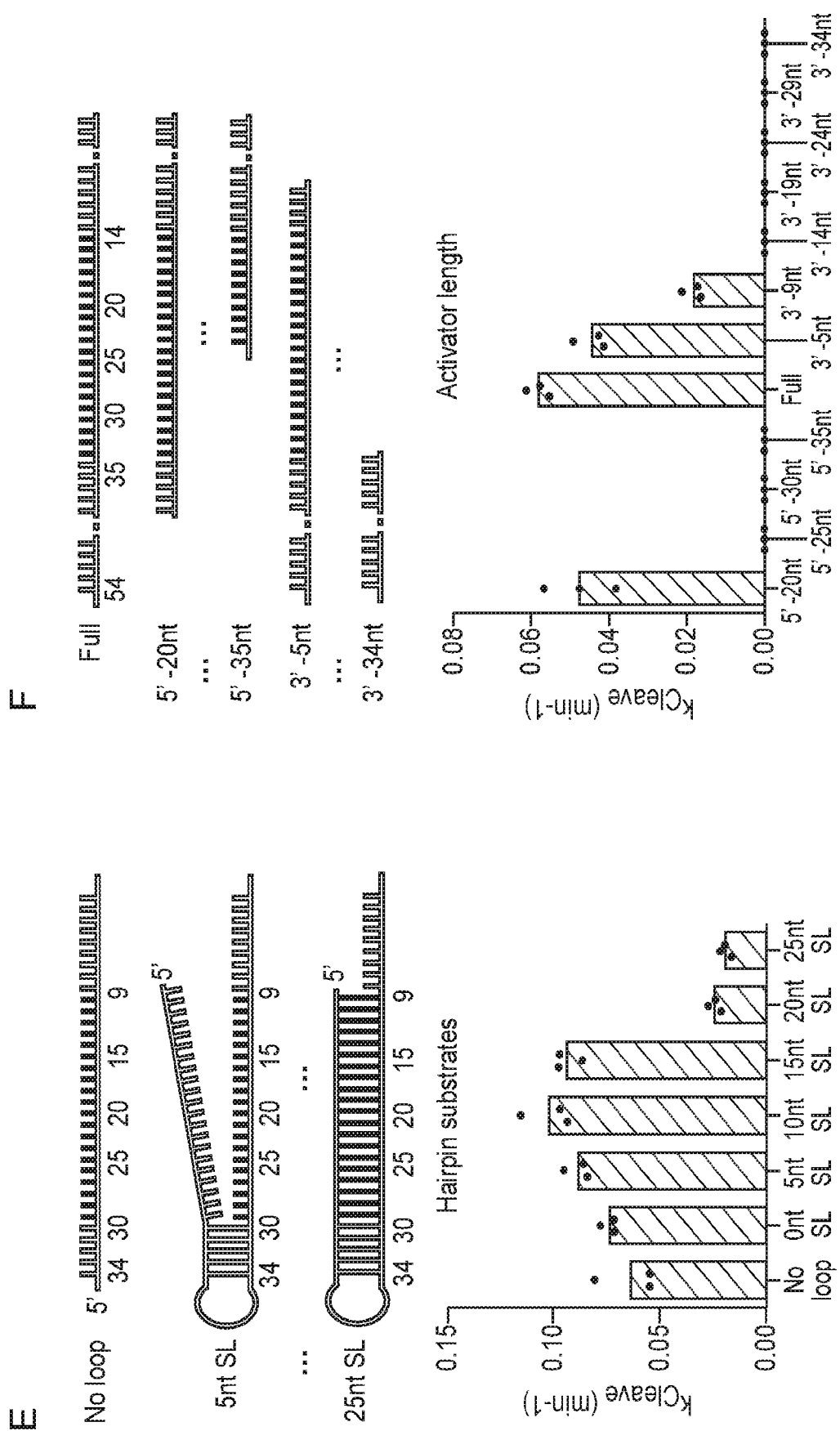

FIG. 43, Panels A-F depict the impact of various activators on Cas14a1 cleavage rate.

Figure 44:
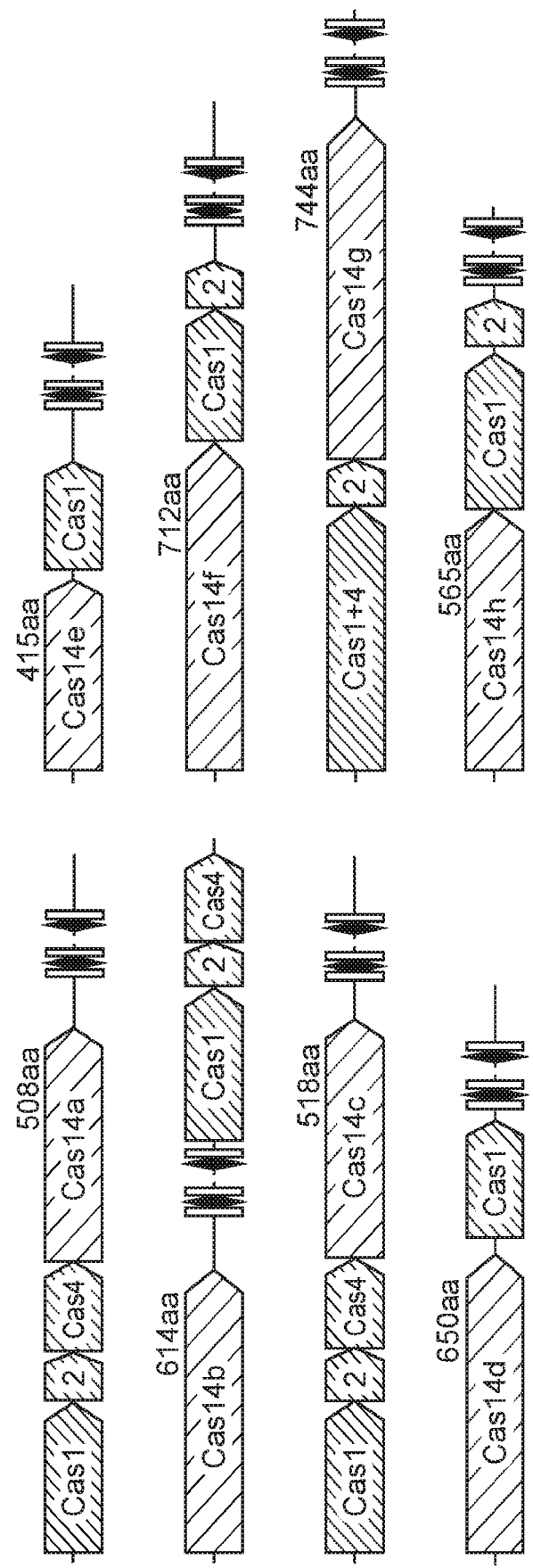
Figure 44:
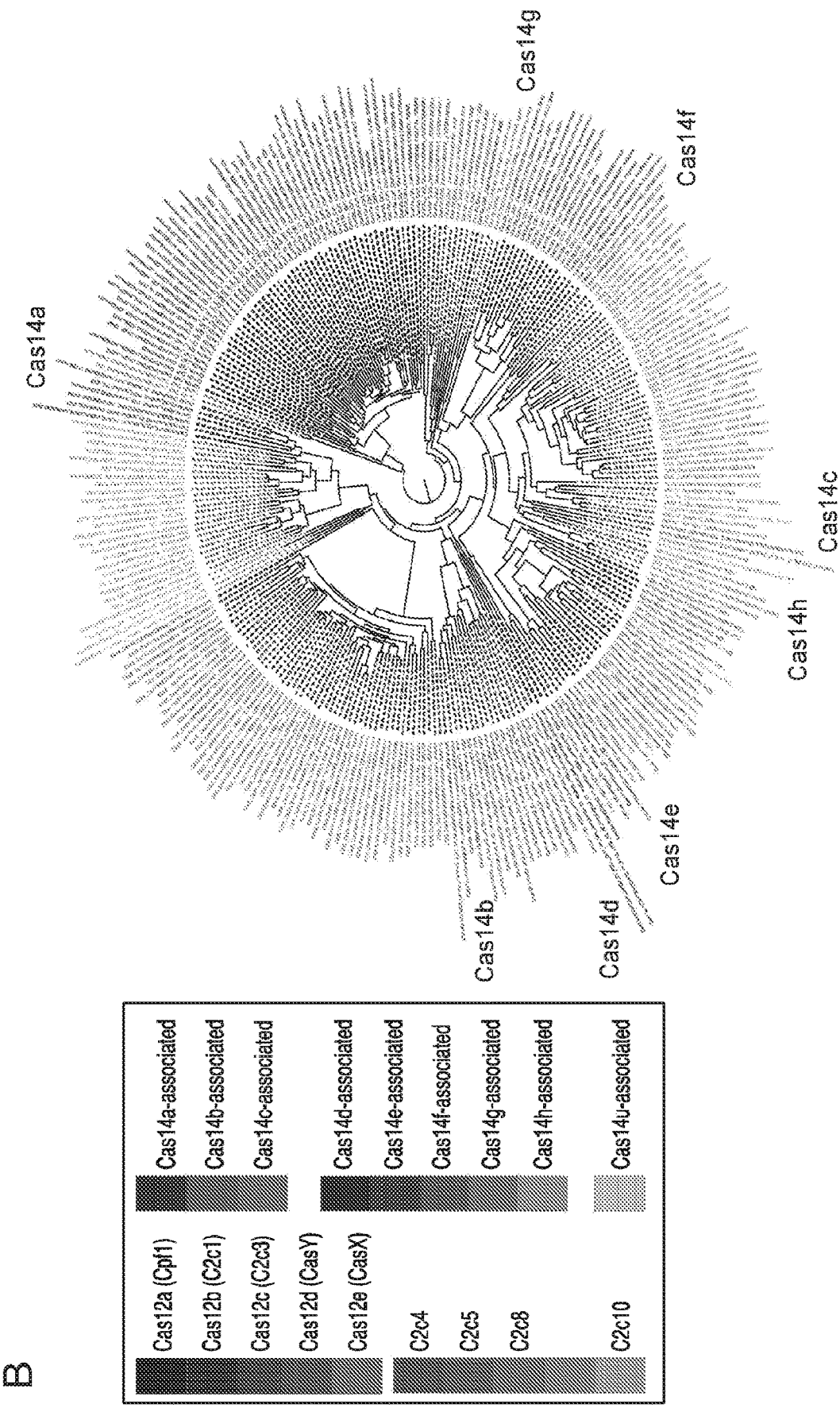

FIG. 44, Panels A-B depict diversity of CRISPR-Cas14 systems.

Figure 45:
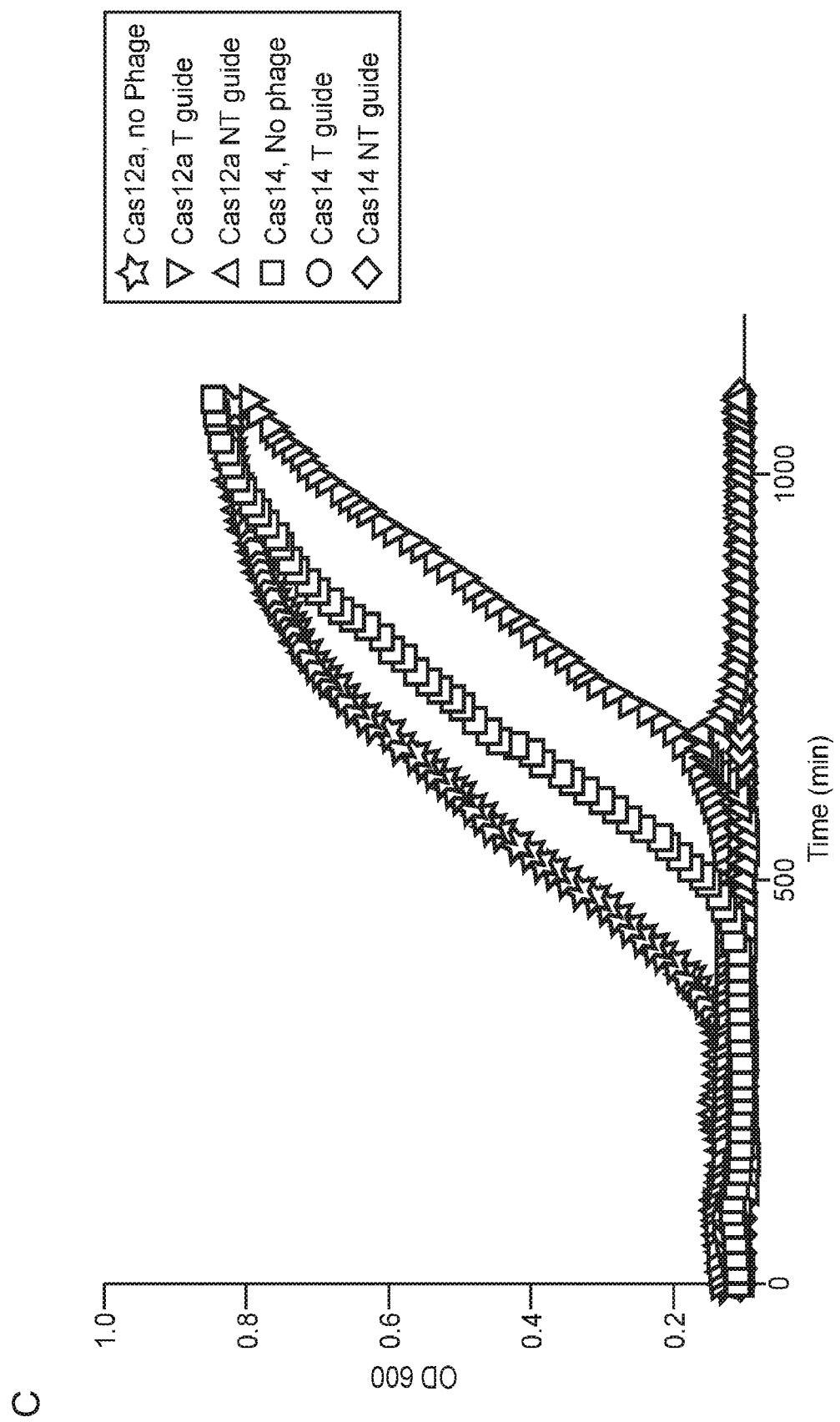

FIG. 45, Panels A-C depict a test of Cas14a1 mediated interference in a heterologous host. Diagram of Cas14a1 and LbCas12a constructs to test interference in E. coli.

Figure 46:
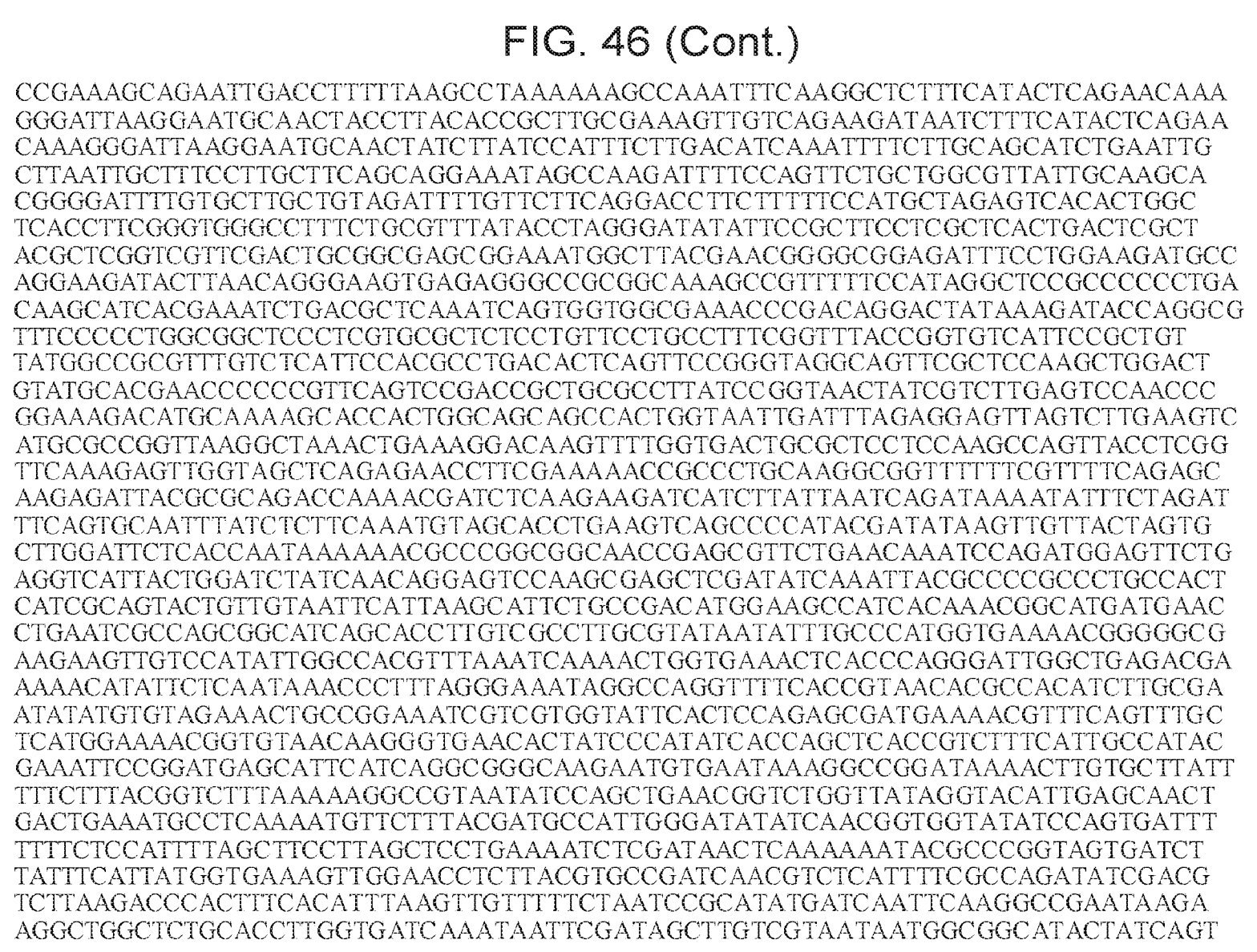
Figure 46:
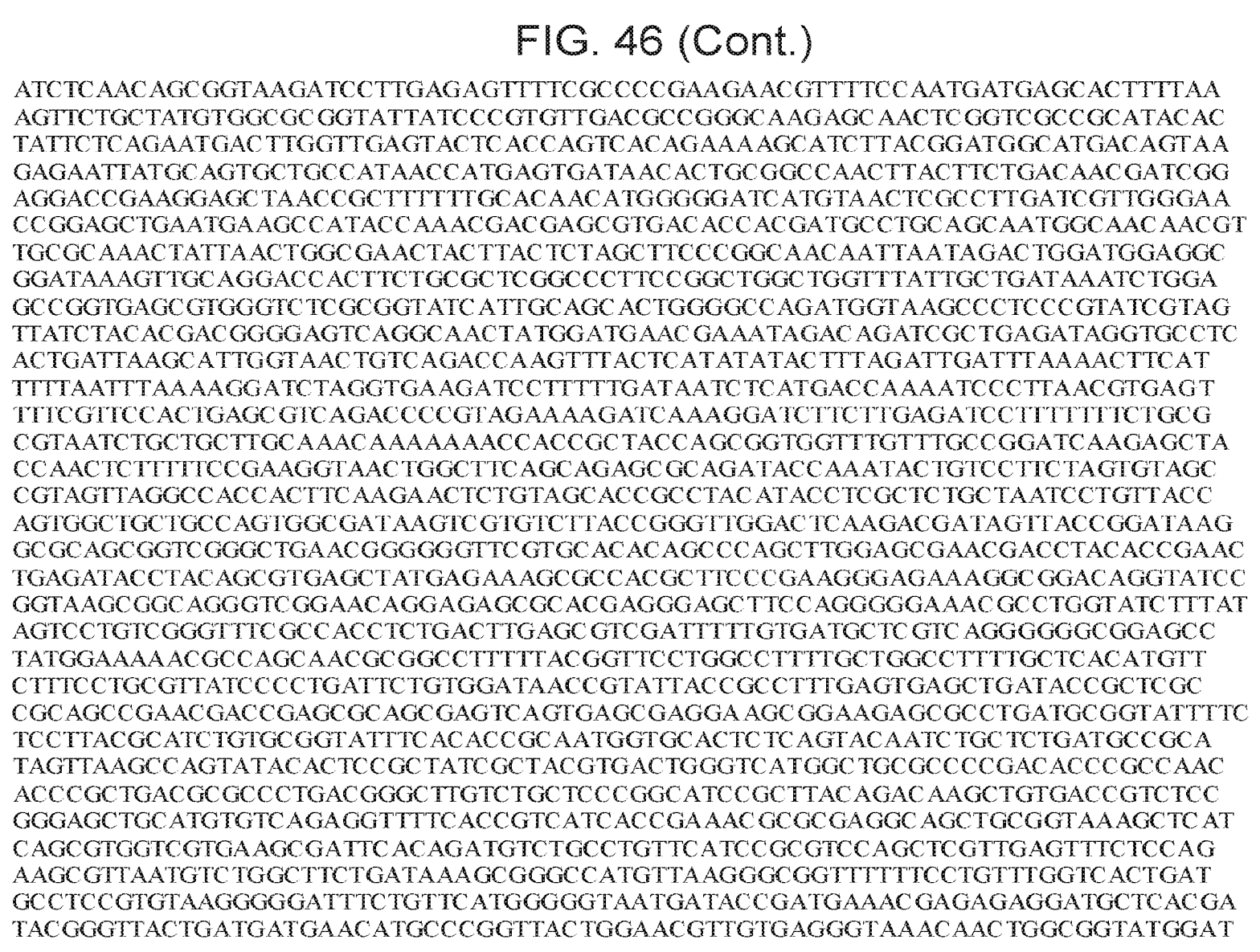

FIG. 46 depicts Cas14 nucleotide sequences of plasmids used in the present invention.

Figure 47:
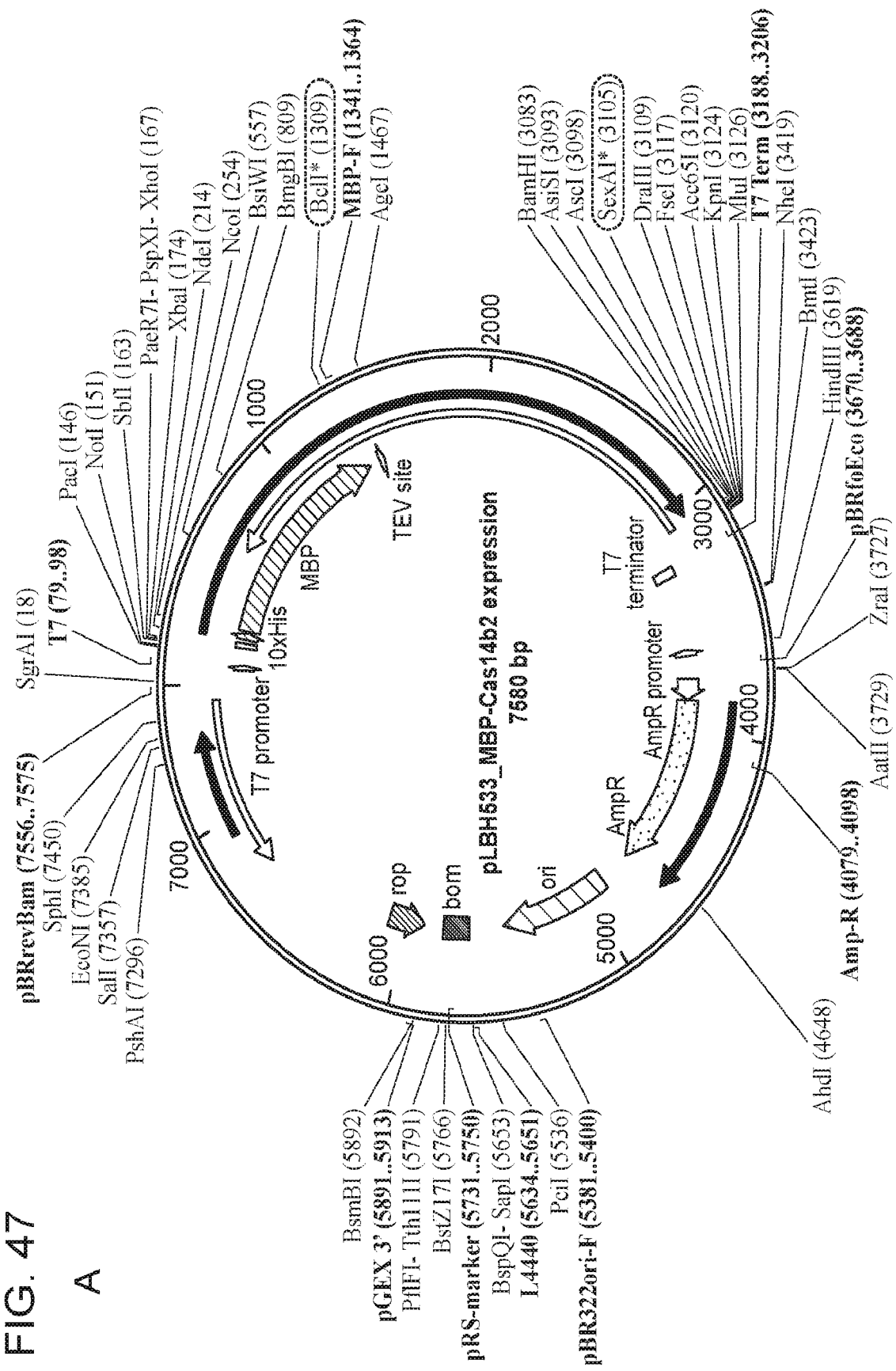
Figure 47:
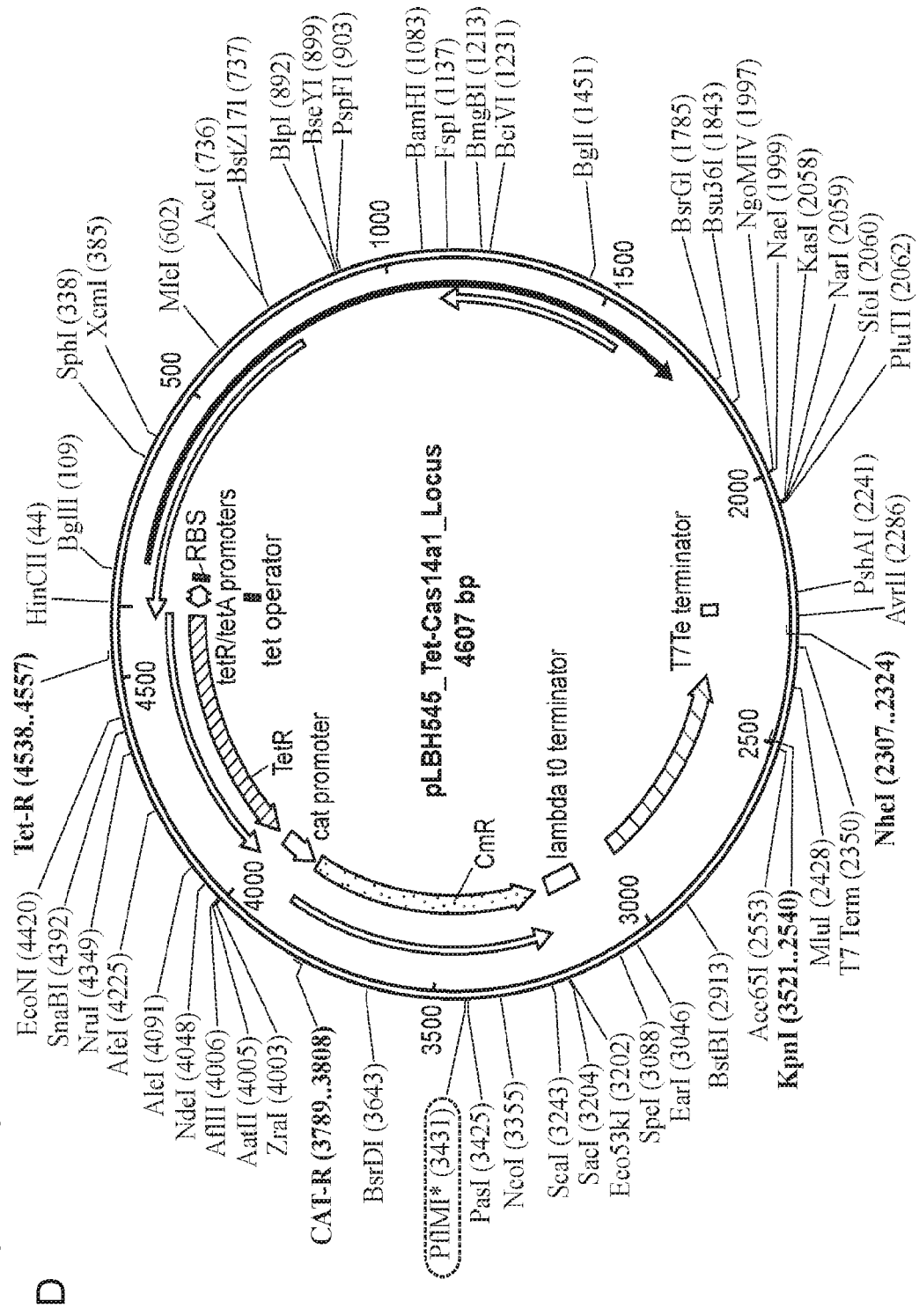
Figure 47:
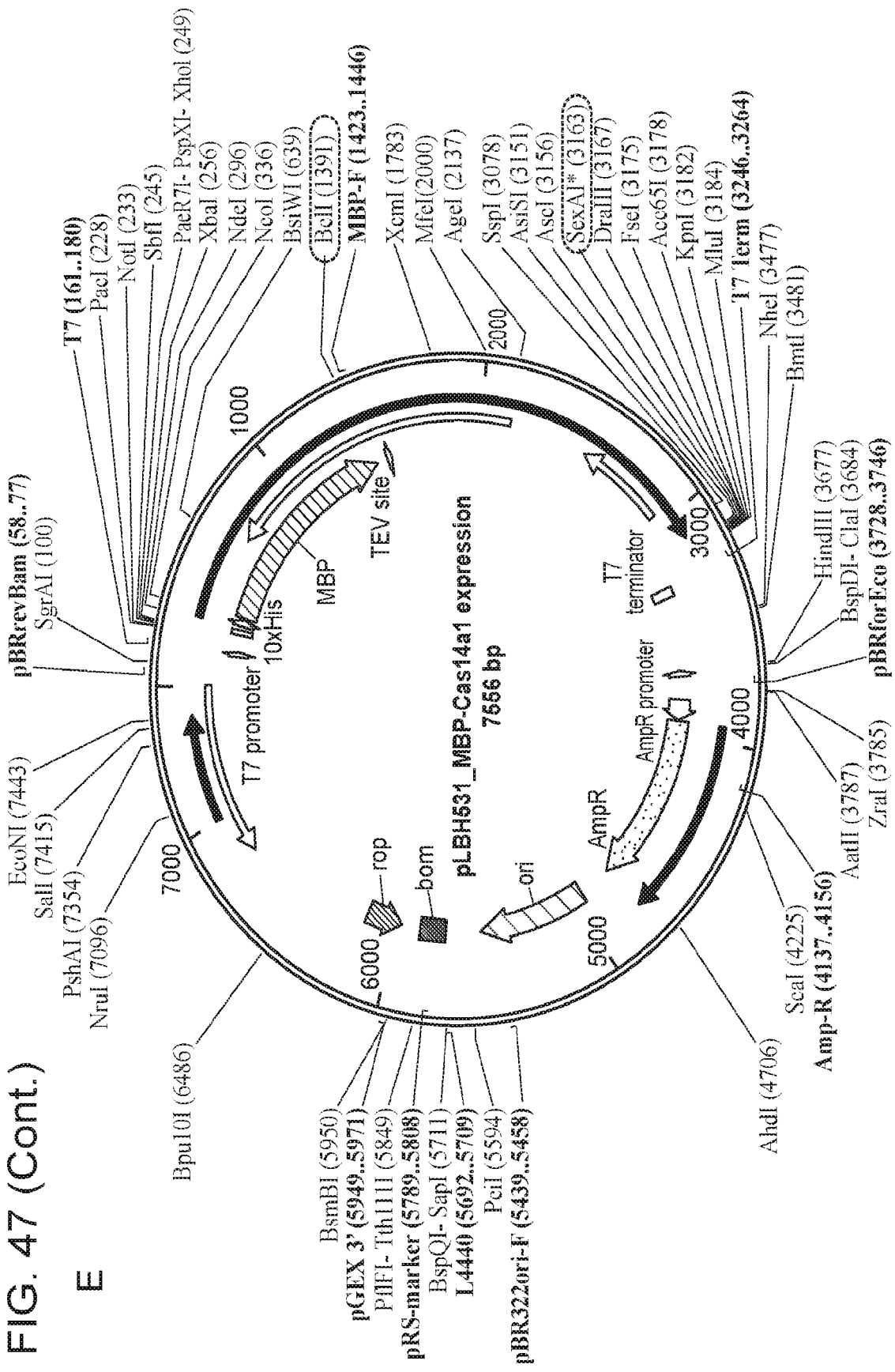

FIG. 47, Panels A-E depict a sequence map of each of the plasmids disclosed in FIG. 24.

FIG. 48 depicts emitted fluorescence signal of "On targets" and "Off target" CasY trans substrates using FQ-ssDNA probes of different nucleotide lengths.

DEFINITIONS

"Heterologous," as used herein, means a nucleotide or polypeptide sequence that is not found in the native nucleic acid or protein, respectively. For example, relative to a Class 2 CRISPR/Cas effector protein, a heterologous polypeptide comprises an amino acid sequence from a protein other than the Class 2 CRISPR/Cas effector protein. In some cases, a portion of a Class 2 CRISPR/Cas effector protein from one species is fused to a portion of a Class 2 CRISPR/Cas effector protein from a different species. The effector protein sequence from each species could therefore be considered to be heterologous relative to one another. As another example, a Class 2 CRISPR/Cas effector protein (e.g., a dEffector protein) can be fused to an active domain from a non-Class 2 CRISPR/Cas effector protein (e.g., a histone deacetylase), and the sequence of the active domain could be considered a heterologous polypeptide (it is heterologous to the effector protein).

The terms "polynucleotide" and "nucleic acid," used interchangeably herein, refer to a polymeric form of nucleotides of any length, either ribonucleotides or deoxynucleotides. Thus, this term includes, but is not limited to, single-, double-, or multi-stranded DNA or RNA, genomic DNA, cDNA, DNA-RNA hybrids, or a polymer comprising purine and pyrimidine bases or other natural, chemically or biochemically modified, non-natural, or derivatized nucleotide bases. The terms "polynucleotide" and "nucleic acid" should be understood to include, as applicable to the embodiment being described, single-stranded (such as sense or antisense) and double-stranded polynucleotides.

The terms "polypeptide," "peptide," and "protein", are used interchangeably herein, refer to a polymeric form of amino acids of any length, which can include genetically coded and non-genetically coded amino acids, chemically or biochemically modified or derivatized amino acids, and polypeptides having modified peptide backbones. The term includes fusion proteins, including, but not limited to, fusion proteins with a heterologous amino acid sequence, fusions with heterologous and homologous leader sequences, with or without N-terminal methionine residues; immunologically tagged proteins; and the like.

The term "naturally-occurring" as used herein as applied to a nucleic acid, a protein, a cell, or an organism, refers to a nucleic acid, cell, protein, or organism that is found in nature.

As used herein the term "isolated" is meant to describe a polynucleotide, a polypeptide, or a cell that is in an environment different from that in which the polynucleotide, the polypeptide, or the cell naturally occurs. An isolated genetically modified host cell may be present in a mixed population of genetically modified host cells.

As used herein, the term "exogenous nucleic acid" refers to a nucleic acid that is not normally or naturally found in and/or produced by a given bacterium, organism, or cell in nature. As used herein, the term "endogenous nucleic acid" refers to a nucleic acid that is normally found in and/or produced by a given bacterium, organism, or cell in nature. An "endogenous nucleic acid" is also referred to as a "native nucleic acid" or a nucleic acid that is "native" to a given bacterium, organism, or cell.

"Recombinant," as used herein, means that a particular nucleic acid (DNA or RNA) is the product of various combinations of cloning, restriction, and/or ligation steps resulting in a construct having a structural coding or non-coding sequence distinguishable from endogenous nucleic acids found in natural systems. Generally, DNA sequences encoding the structural coding sequence can be assembled from cDNA fragments and short oligonucleotide linkers, or from a series of synthetic oligonucleotides, to provide a synthetic nucleic acid which is capable of being expressed from a recombinant transcriptional unit contained in a cell or in a cell-free transcription and translation system. Such sequences can be provided in the form of an open reading frame uninterrupted by internal non-translated sequences, or introns, which are typically present in eukaryotic genes. Genomic DNA comprising the relevant sequences can also be used in the formation of a recombinant gene or transcriptional unit. Sequences of non-translated DNA may be present 5' or 3' from the open reading frame, where such sequences do not interfere with manipulation or expression of the coding regions, and may indeed act to modulate production of a desired product by various mechanisms (see "DNA regulatory sequences", below).

Thus, e.g., the term "recombinant" polynucleotide or "recombinant" nucleic acid refers to one which is not naturally occurring, e.g., is made by the artificial combination of two otherwise separated segments of sequence through human intervention. This artificial combination is often accomplished by either chemical synthesis means, or by the artificial manipulation of isolated segments of nucleic acids, e.g., by genetic engineering techniques. Such is usually done to replace a codon with a redundant codon encoding the same or a conservative amino acid, while typically introducing or removing a sequence recognition site. Alternatively, it is performed to join together nucleic acid segments of desired functions to generate a desired combination of functions. This artificial combination is often accomplished by either chemical synthesis means, or by the artificial manipulation of isolated segments of nucleic acids, e.g., by genetic engineering techniques.

Similarly, the term "recombinant" polypeptide refers to a polypeptide which is not naturally occurring, e.g., is made by the artificial combination of two otherwise separated segments of amino sequence through human intervention. Thus, e.g., a polypeptide that comprises a heterologous amino acid sequence is recombinant.

By "construct" or "vector" is meant a recombinant nucleic acid, generally recombinant DNA, which has been generated for the purpose of the expression and/or propagation of a specific nucleotide sequence(s), or is to be used in the construction of other recombinant nucleotide sequences.

The terms "DNA regulatory sequences," "control elements," and "regulatory elements," used interchangeably herein, refer to transcriptional and translational control sequences, such as promoters, enhancers, polyadenylation signals, terminators, protein degradation signals, and the like, that provide for and/or regulate expression of a coding sequence and/or production of an encoded polypeptide in a host cell.

The term "transformation" is used interchangeably herein with "genetic modification" and refers to a permanent or transient genetic change induced in a cell following introduction of new nucleic acid (e.g., DNA exogenous to the cell) into the cell. Genetic change ("modification") can be accomplished either by incorporation of the new nucleic acid into the genome of the host cell, or by transient or stable maintenance of the new nucleic acid as an episomal element. Where the cell is a eukaryotic cell, a permanent genetic change is generally achieved by introduction of new DNA into the genome of the cell. In prokaryotic cells, permanent changes can be introduced into the chromosome or via extrachromosomal elements such as plasmids and expression vectors, which may contain one or more selectable markers to aid in their maintenance in the recombinant host cell. Suitable methods of genetic modification include viral infection, transfection, conjugation, protoplast fusion, electroporation, particle gun technology, calcium phosphate precipitation, direct microinjection, and the like. The choice of method is generally dependent on the type of cell being transformed and the circumstances under which the transformation is taking place (i.e. in vitro, ex vivo, or in vivo). A general discussion of these methods can be found in Ausubel, et al, Short Protocols in Molecular Biology, 3rd ed., Wiley & Sons, 1995.

"Operably linked" refers to a juxtaposition wherein the components so described are in a relationship permitting them to function in their intended manner. For instance, a promoter is operably linked to a coding sequence if the promoter affects its transcription or expression. As used herein, the terms "heterologous promoter" and "heterologous control regions" refer to promoters and other control regions that are not normally associated with a particular nucleic acid in nature. For example, a "transcriptional control region heterologous to a coding region" is a transcriptional control region that is not normally associated with the coding region in nature.

A "host cell," as used herein, denotes an in vivo or in vitro eukaryotic cell, a prokaryotic cell, or a cell from a multicellular organism (e.g., a cell line) cultured as a unicellular entity, which eukaryotic or prokaryotic cells can be, or have been, used as recipients for a nucleic acid (e.g., an expression vector), and include the progeny of the original cell which has been genetically modified by the nucleic acid. It is understood that the progeny of a single cell may not necessarily be completely identical in morphology or in genomic or total DNA complement as the original parent, due to natural, accidental, or deliberate mutation. A "recombinant host cell" (also referred to as a "genetically modified host cell") is a host cell into which has been introduced a heterologous nucleic acid, e.g., an expression vector. For example, a subject prokaryotic host cell is a genetically modified prokaryotic host cell (e.g., a bacterium), by virtue of introduction into a suitable prokaryotic host cell of a heterologous nucleic acid, e.g., an exogenous nucleic acid that is foreign to (not normally found in nature in) the prokaryotic host cell, or a recombinant nucleic acid that is not normally found in the prokaryotic host cell; and a subject eukaryotic host cell is a genetically modified eukaryotic host cell, by virtue of introduction into a suitable eukaryotic host cell of a heterologous nucleic acid, e.g., an exogenous nucleic acid that is foreign to the eukaryotic host cell, or a recombinant nucleic acid that is not normally found in the eukaryotic host cell.

The term "conservative amino acid substitution" refers to the interchangeability in proteins of amino acid residues having similar side chains. For example, a group of amino acids having aliphatic side chains consists of glycine, alanine, valine, leucine, and isoleucine; a group of amino acids having aliphatic-hydroxyl side chains consists of serine and threonine; a group of amino acids having amide-containing side chains consists of asparagine and glutamine; a group of amino acids having aromatic side chains consists of phenylalanine, tyrosine, and tryptophan; a group of amino acids having basic side chains consists of lysine, arginine, and histidine; and a group of amino acids having sulfur-containing side chains consists of cysteine and methionine. Exemplary conservative amino acid substitution groups are: valine-leucine-isoleucine, phenylalanine-tyrosine, lysine-arginine, alanine-valine, and asparagine-glutamine.

A polynucleotide or polypeptide has a certain percent "sequence identity" to another polynucleotide or polypeptide, meaning that, when aligned, that percentage of bases or amino acids are the same, and in the same relative position, when comparing the two sequences. Sequence similarity can be determined in a number of different manners. To determine sequence identity, sequences can be aligned using the methods and computer programs, including BLAST, available over the world wide web at ncbi.nlm.nih.gov/BLAST. See, e.g., Altschul et al. (1990), *J. Mol. Biol.* 215:403-10. Another alignment algorithm is FASTA, available in the Genetics Computing Group (GCG) package, from Madison, Wis., USA, a wholly owned subsidiary of Oxford Molecular Group, Inc. Other techniques for alignment are described in Methods in Enzymology, vol. 266: Computer Methods for Macromolecular Sequence Analysis (1996), ed. Doolittle, Academic Press, Inc., a division of Harcourt Brace & Co., San Diego, Calif., USA. Of particular interest are alignment programs that permit gaps in the sequence. The Smith-Waterman is one type of algorithm that permits gaps in sequence alignments. See *Meth. Mol. Biol.* 70: 173-187 (1997). Also, the GAP program using the Needleman and Wunsch alignment method can be utilized to align sequences. See *J. Mol. Biol.* 48: 443-453 (1970).

As used herein, the terms "treatment," "treating," and the like, refer to obtaining a desired pharmacologic and/or physiologic effect. The effect may be prophylactic in terms of completely or partially preventing a disease or symptom thereof and/or may be therapeutic in terms of a partial or complete cure for a disease and/or adverse effect attributable to the disease. "'Treatment," as used herein, covers any treatment of a disease in a mammal, e.g., in a human, and includes: (a) preventing the disease from occurring in a subject which may be predisposed to the disease but has not yet been diagnosed as having it; (b) inhibiting the disease, i.e., arresting its development; and (c) relieving the disease, i.e., causing regression of the disease.

The terms "individual," "subject," "host," and "patient," used interchangeably herein, refer to an individual organism, e.g., a mammal, including, but not limited to, murines, simians, non-human primates, humans, mammalian farm animals, mammalian sport animals, and mammalian pets.

Before the present invention is further described, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the invention. The upper and lower limits of these smaller ranges may independently be included in the smaller ranges, and are also encompassed within the invention, subject to any specifically excluded limit in the stated range. Where the stated range includes one or both of the limits, ranges excluding either or both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, the preferred methods and materials are now described. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise. Thus, for example, reference to "a Class 2 CRISPR/Cas effector protein" includes a plurality of such polypeptides and reference to "the guide RNA" includes reference to one or more guide RNAs and equivalents thereof known to those skilled in the art, and so forth. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable sub-combination. All combinations of the embodiments pertaining to the invention are specifically embraced by the present invention and are disclosed herein just as if each and every combination was individually and explicitly disclosed. In addition, all sub-combinations of the various embodiments and elements thereof are also specifically embraced by the present invention and are disclosed herein just as if each and every such sub-combination was individually and explicitly disclosed herein.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

DETAILED DESCRIPTION

The present disclosure provides compositions and methods that include one or more of: (1) a Class 2 CRISPR/Cas effector protein, a nucleic acid encoding the effector protein, and/or a modified host cell comprising the effector protein (and/or a nucleic acid encoding the same); (2) a CRISPR/Cas guide RNA that binds to and provides sequence specificity to the effector protein, a nucleic acid encoding the guide RNA, and/or a modified host cell comprising the guide RNA (and/or a nucleic acid encoding the same); and (3) a CRISPR/Cas transactivating noncoding RNA (trancRNA), a nucleic acid encoding the trancRNA, and/or a modified host cell comprising the trancRNA (and/or a nucleic acid encoding the same)

Compositions

Crispr/Cas12c Proteins, Guide RNAs, and TrancRNAs

Class 2 CRISPR-Cas systems are characterized by effector modules that include a single multidomain protein. For example, in a Class 2 CRISPR/Cas system, a CRISPR/Cas endonuclease (e.g., a Cas12c protein) interacts with (binds to) a corresponding guide RNA (e.g., a Cas12c guide RNA) to form a ribonucleoprotein (RNP) complex that is targeted to a particular site in a target nucleic acid via base pairing between the guide RNA and a target sequence within the target nucleic acid molecule. Likewise, in a CasY system, a CRISPR/Cas endonuclease (e.g., a CasY protein) interacts with (binds to) a corresponding guide RNA (e.g., a CasY guide RNA) to form the RNP; in a CasZ system, a CRISPR/Cas endonuclease (e.g., a CasZ protein) interacts with (binds to) a corresponding guide RNA (e.g., a CasZ guide RNA) to form the RNP; and in a Cas9 system, a CRISPR/Cas endonuclease (e.g., a Cas9 protein) interacts with (binds to) a corresponding guide RNA (e.g., a Cas9 guide RNA) to form the RNP.

A guide RNA includes a nucleotide sequence (a guide sequence) that is complementary to a sequence (the target site) of a target nucleic acid. Thus, a Class 2 CRISPR/Cas effector protein (e.g., CasY, CasZ, Cas12c, and the like) forms a complex with a corresponding guide RNA (e.g., CasY, CasZ, Cas12c guide RNA) and the guide RNA provides sequence specificity to the RNP complex via the guide sequence. The effector protein of the complex provides the site-specific activity. In other words, the Class 2 CRTSPR/Cas effector protein is guided to a target site (e.g., stabilized at a target site) within a target nucleic acid (e.g. a target nucleotide sequence within a target chromosomal nucleic acid; or a target nucleotide sequence within a target extrachromosomal nucleic acid, e.g., an episomal nucleic acid, a minicircle nucleic acid, a mitochondrial nucleic acid, a chloroplast nucleic acid, etc.) by virtue of its association with the guide RNA.

The present disclosure provides compositions comprising a Class 2 CRISPR/Cas effector protein (and/or a nucleic acid encoding the effector protein) (e.g., where the effector protein can be a naturally existing protein, a nickase, a dEffector protein (e.g., dCas12c, dCasY, dCasZ, and the like), a chimeric effector protein, etc.). The present disclosure provides a composition comprising a CRISPR/Cas guide RNA (and/or a nucleic acid encoding the guide RNA). The present disclosure provides a composition comprising a CRISPR/Cas trancRNA (and/or a nucleic acid encoding the trancRNA).

For example, the present disclosure provides compositions comprising (a) a CRISPR/Cas trancRNA (and/or a nucleic acid encoding the CRISPR/Cas trancRNA); and at least one of: (b) a Class 2 CRISPR/Cas effector protein (and/or a nucleic acid encoding the Class 2 CRISPR/Cas effector protein); and (c) a CRISPR/Cas guide RNA (and/or a nucleic acid encoding the CRISPR/Cas guide RNA). The present disclosure provides a nucleic acid/protein complex (RNP complex) comprising: a CRISPR/Cas trancRNA, a Class 2 CRISPR/Cas effector protein, and a CRISPR/Cas guide RNA.

Class 2 CRISPR/Cas Effector Protein

A Class 2 CRISPR/Cas effector protein can bind and/or modify (e.g., cleave, nick, methylate, demethylate, etc.) a target nucleic acid and/or a polypeptide associated with target nucleic acid (e.g., methylation or acetylation of a histone tail) (e.g., in some cases the effector protein includes a fusion partner with an activity, and in some cases the effector protein provides nuclease activity). In some cases, the effector protein is a naturally-occurring protein (e.g., naturally occurs in prokaryotic cells). In other cases, the Class 2 CRISPR/Cas effector protein is not a naturally-occurring polypeptide (e.g., the effector protein is a variant protein, a chimeric protein, and the like). Examples of naturally occurring Class 2 CRISPR/Cas effector proteins include, but are not limited to, those depicted in FIG. 1. Any Class 2 CRISPR/Cas effector protein is suitable for the compositions (e.g., nucleic acids, kits, etc.) and methods of the present disclosure (e.g., as long as the Class 2 CRISPR/Cas effector protein forms a complex with a guide RNA and a trancRNA, and/or is from (or derived from) a CRISPR/Cas system that expresses a trancRNA that is used as part of the system's CRISPR/Cas adaptive immunity).

i. Cas12c (C2c3) Proteins

One example of a naturally existing Class 2 CRISPR/Cas effector protein is Cas12c. A Cas12c protein includes 3 partial RuvC domains (RuvC-1, RuvC-11, and RuvC-111, also referred to herein as subdomains) that are not contiguous with respect to the primary amino acid sequence of the Cas12c protein, but form a RuvC domain once the protein is produced and folds. A naturally occurring Cas12c protein functions as an endonuclease that catalyzes cleavage at a specific sequence in a targeted double stranded DNA (dsDNA). The sequence specificity is provided by the associated guide RNA, which hybridizes to a target sequence within the target DNA. The naturally occurring Cas12c guide RNA is a crRNA, where the crRNA includes (i) a guide sequence that hybridizes to a target sequence in the target DNA and (ii) a protein binding segment that binds to the Cas12c protein.

In some embodiments, the Class 2 CRISPR/Cas effector protein of the subject methods and/or compositions is (or is derived from) a naturally occurring (wild type) C12c protein. Examples of naturally occurring Cas12c proteins are depicted in FIG. 1. It is important to note that Cas12c is short compared to previously identified CRISPR-Cas endonucleases, and thus use of this protein as an alternative provides the advantage that the nucleotide sequence encoding the protein is relatively short. This is useful, for example, in cases where a nucleic acid encoding the Cas12c protein is desirable, e.g., in situations that employ a viral vector (e.g., an AAV vector), for delivery to a cell such as a eukaryotic cell (e.g., mammalian cell, human cell, mouse cell, in vitro, ex vivo, in vivo) for research and/or clinical applications.

In some cases, a Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the Cas12c_1 protein sequence set forth as Cas12c (C2c3)_1 in FIG. 1. For example, in some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the Cas12c protein sequence set forth as Cas12c (C2c3)_1 in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the Cas12c protein sequence set forth as Cas12c (C2c3)_1 in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the Cas12c protein sequence set forth as Cas12c (C2c3)_1 in FIG. 1. In some cases, a Class 2 CRISPR/Cas effector protein includes an amino acid sequence having the Cas12c protein sequence set forth as Cas12c (C2c3)_1 in FIG. 1. In some cases, a Class 2 CRISPR/Cas effector protein includes an amino acid sequence having the Cas12c protein sequence set forth as Cas12c (C2c3)_1 in FIG. 1, with the exception that the sequence includes an amino acid substitution (e.g., 1, 2, or 3 amino acid substitutions) that reduces the naturally occurring catalytic activity of the protein (e.g., such as at one or more catalytic amino acid positions).

In some cases, a Class 2 CRISPR/Cas effector protein includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the Cas12c protein sequence set forth as Cas12c (C2c3)_2 in FIG. 1. In some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the Cas12c protein sequence set forth as Cas12c (C2c3)_2 in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the Cas12c protein sequence set forth as Cas12c (C2c3)_2 in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the Cas12c protein sequence set forth as Cas12c (C2c3)_2 in FIG. 1. In some cases, a Class 2 CRISPR/Cas effector protein includes an amino acid sequence having the Cas12c protein sequence set forth as Cas12c (C2c3)_2 in FIG. 1. In some cases, a Class 2 CRISPR/Cas effector protein includes an amino acid sequence having the Cas12c protein sequence set forth as Cas12c (C2c3)_2 in FIG. 1, with the exception that the sequence includes an amino acid substitution (e.g., 1, 2, or 3 amino acid substitutions) that reduces the naturally occurring catalytic activity of the protein (e.g., such as at one or more catalytic amino acid positions).

In some cases, a Class 2 CRISPR/Cas effector protein includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the Cas12c protein sequence set forth as Cas12c (C2c3)_3 in FIG. 1. In some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the Cas12c protein sequence set forth as Cas12c (C2c3)_3 in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the Cas12c protein sequence set forth as Cas12c (C2c3)_3 in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the Cas12c protein sequence set forth as Cas12c (C2c3)_3 in FIG. 1. In some cases, a Class 2 CRISPR/Cas effector protein includes an amino acid sequence having the Cas12c protein sequence set forth as Cas12c (C2c3)_3 in FIG. 1. In some cases, a Class 2 CRISPR/Cas effector protein includes an amino acid sequence having the Cas12c protein sequence set forth as Cas12c (C2c3)_3 in FIG. 1, with the exception that the sequence includes an amino acid substitution (e.g., 1, 2, or 3 amino acid substitutions) that reduces the naturally occurring catalytic activity of the protein (e.g., such as at one or more catalytic amino acid positions).

In some cases, a Class 2 CRISPR/Cas effector protein includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the Cas12c protein sequence set forth as Cas12c (C2c3)_4 in FIG. 1. In some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the Cas12c protein sequence set forth as Cas12c (C2c3)_4 in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the Cas12c protein sequence set forth as Cas12c (C2c3)_4 in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the Cas12c protein sequence set forth as Cas12c (C2c3)_4 in FIG. 1. In some cases, a Class 2 CRISPR/Cas effector protein includes an amino acid sequence having the Cas12c protein sequence set forth as Cas12c (C2c3)_4 in FIG. 1. In some cases, a Class 2 CRISPR/Cas effector protein includes an amino acid sequence having the Cas12c protein sequence set forth as Cas12c (C2c3)_4 in FIG. 1, with the exception that the sequence includes an amino acid substitution (e.g., 1, 2, or 3 amino acid substitutions) that reduces the naturally occurring catalytic activity of the protein (e.g., such as at one or more catalytic amino acid positions).

In some cases, a Class 2 CRISPR/Cas effector protein includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the Cas12c protein sequence set forth as Cas12c (C2c3)_5 in FIG. 1. In some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the Cas12c protein sequence set forth as Cas12c (C2c3)_5 in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the Cas12c protein sequence set forth as Cas12c (C2c3)_5 in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the Cas12c protein sequence set forth as Cas12c (C2c3)_5 in FIG. 1. In some cases, a Class 2 CRISPR/Cas effector protein includes an amino acid sequence having the Cas12c protein sequence set forth as Cas12c (C2c3)_5 in FIG. 1. In some cases, a Class 2 CRISPR/Cas effector protein includes an amino acid sequence having the Cas12c protein sequence set forth as Cas12c (C2c3)_5 in FIG. 1, with the exception that the sequence includes an amino acid substitution (e.g., 1, 2, or 3 amino acid substitutions) that reduces the naturally occurring catalytic activity of the protein (e.g., such as at one or more catalytic amino acid positions).

In some cases, a Class 2 CRISPR/Cas effector protein includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the Cas12c protein sequence set forth as Cas12c (C2c3)_6 in FIG. 1. In some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the Cas12c protein sequence set forth as Cas12c (C2c3)_6 in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the Cas12c protein sequence set forth as Cas12c (C2c3)_6 in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the Cas12c protein sequence set forth as Cas12c (C2c3)_6 in FIG. 1. In some cases, a Class 2 CRISPR/Cas effector protein includes an amino acid sequence having the Cas12c protein sequence set forth as Cas12c (C2c3)_6 in FIG. 1. In some cases, a Class 2 CRISPR/Cas effector protein includes an amino acid sequence having the Cas12c protein sequence set forth as Cas12c (C2c3)_6 in FIG. 1, with the exception that the sequence includes an amino acid substitution (e.g., 1, 2, or 3 amino acid substitutions) that reduces the naturally occurring catalytic activity of the protein (e.g., such as at one or more catalytic amino acid positions).

In some cases, a Class 2 CRISPR/Cas effector protein includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the Cas12c protein sequence set forth as Cas12c (C2c3)_7 in FIG. 1. In some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the Cas12c protein sequence set forth as Cas12c (C2c3)_7 in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the Cas12c protein sequence set forth as Cas12c (C2c3)_7 in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the Cas12c protein sequence set forth as Cas12c (C2c3)_7 in FIG. 1. In some cases, a Class 2 CRISPR/Cas effector protein includes an amino acid sequence having the Cas12c protein sequence set forth as Cas12c (C2c3)_7 in FIG. 1. In some cases, a Class 2 CRISPR/Cas effector protein includes an amino acid sequence having the Cas12c protein sequence set forth as Cas12c (C2c3)_7 in FIG. 1, with the exception that the sequence includes an amino acid substitution (e.g., 1, 2, or 3 amino acid substitutions) that reduces the naturally occurring catalytic activity of the protein (e.g., such as at one or more catalytic amino acid positions).

In some cases, a Class 2 CRISPR/Cas effector protein includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the Cas12c protein sequence set forth as Cas12c (C2c3)_8 in FIG. 1. In some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the Cas12c protein sequence set forth as Cas12c (C2c3)_8 in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the Cas12c protein sequence set forth as Cas12c (C2c3)_8 in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the Cas12c protein sequence set forth as Cas12c (C2c3)_8 in FIG. 1. In some cases, a Class 2 CRISPR/Cas effector protein includes an amino acid sequence having the Cas12c protein sequence set forth as Cas12c (C2c3)_8 in FIG. 1. In some cases, a Class 2 CRISPR/Cas effector protein includes an amino acid sequence having the Cas12c protein sequence set forth as Cas12c (C2c3)_8 in FIG. 1, with the exception that the sequence includes an amino acid substitution (e.g., 1, 2, or 3 amino acid substitutions) that reduces the naturally occurring catalytic activity of the protein (e.g., such as at one or more catalytic amino acid positions).

In some cases, a Class 2 CRISPR/Cas effector protein includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with any one of the Cas12c (C2c3) protein sequences depicted in FIG. 1. In some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with any one of the Cas12c (C2c3) protein sequences depicted in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with any one of the Cas12c (C2c3) protein sequences depicted in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with any one of the Cas12c (C2c3) protein sequences depicted in FIG. 1. In some cases, a Class 2 CRISPR/Cas effector protein includes an amino acid sequence having a Cas12c (C2c3) protein sequence depicted in FIG. 1. In some cases, a Class 2 CRISPR/Cas effector protein includes an amino acid sequence having a Cas12c (C2c3) protein sequence depicted in FIG. 1, with the exception that the sequence includes an amino acid substitution (e.g., 1, 2, or 3 amino acid substitutions) that reduces the naturally occurring catalytic activity of the protein (e.g., such as at one or more catalytic amino acid positions, described in more detail elsewhere in this disclosure).

In some cases, a Class 2 CRISPR/Cas effector protein includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the Cas12c (C2c3)_1, Cas12c (C2c3)_2, Cas12c (C2c3)_7, or Cas12c (C2c3)_8 depicted in FIG. 1. In some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the Cas12c (C2c3)_1, Cas12c (C2c3)_2, Cas12c (C2c3)_7, or Cas12c (C2c3)_8 depicted in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the Cas12c (C2c3)_1, Cas12c (C2c3)_2, Cas12c (C2c3)_7, or Cas12c (C2c3)_8 depicted in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the Cas12c (C2c3)_1, Cas12c (C2c3)_2, Cas12c (C2c3)_7, or Cas12c (C2c3)_8 depicted in FIG. 1. In some cases, a Class 2 CRISPR/Cas effector protein includes an amino acid sequence having the Cas12c (C2c3)_1, Cas12c (C2c3)_2, Cas12c (C2c3)_7, or Cas12c (C2c3)_8 protein sequence depicted in FIG. 1. In some cases, a Class 2 CRISPR/Cas effector protein includes an amino acid sequence having the Cas12c (C2c3)_1, Cas12c (C2c3)_2, Cas12c (C2c3)_7, or Cas12c (C2c3)_8 protein sequence depicted in FIG. 1, with the exception that the sequence includes an amino acid substitution (e.g., 1, 2, or 3 amino acid substitutions) that reduces the naturally occurring catalytic activity of the protein (e.g., such as at one or more catalytic amino acid positions, described in more detail elsewhere in this disclosure).

In some cases, a Class 2 CRISPR/Cas effector protein includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the Cas12c (C2c3)_3, Cas12c (C2c3)_4, Cas12c (C2c3)_5, or Cas12c (C2c3)_6 depicted in FIG. 1. In some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the Cas12c (C2c3)_3, Cas12c (C2c3)_4, Cas12c (C2c3)_5, or Cas12c (C2c3)_6 depicted in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the Cas12c (C2c3)_3, Cas12c (C2c3)_4, Cas12c (C2c3)_5, or Cas12c (C2c3)_6 depicted in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the Cas12c (C2c3)_3, Cas12c (C2c3)_4, Cas12c (C2c3)_5, or Cas12c (C2c3)_6 depicted in FIG. 1. In some cases, a Class 2 CRISPR/Cas effector protein includes an amino acid sequence having the Cas12c (C2c3)_3, Cas12c (C2c3)_4, Cas12c (C2c3)_5, or Cas12c (C2c3)_6 protein sequence depicted in FIG. 1. In some cases, a Class 2 CRISPR/Cas effector protein includes an amino acid sequence having the Cas12c (C2c3)_3, Cas12c (C2c3)_4, Cas12c (C2c3)_5, or Cas12c (C2c3)_6 protein sequence depicted in FIG. 1, with the exception that the sequence includes an amino acid substitution (e.g., 1, 2, or 3 amino acid substitutions) that reduces the naturally occurring catalytic activity of the protein (e.g., such as at one or more catalytic amino acid positions, described in more detail elsewhere in this disclosure).

ii. CasY Proteins

Another example of a naturally existing Class 2 CRISPR/Cas effector protein is CasY. A CasY polypeptide (this term is used interchangeably with the term "CasY protein") can bind and/or modify (e.g., cleave, nick, methylate, demethylate, etc.) a target nucleic acid and/or a polypeptide associated with target nucleic acid (e.g., methylation or acetylation of a histone tail) (e.g., in some cases a CasY protein includes a fusion partner with an activity, and in some cases the CasY protein provides nuclease activity). In some cases, the Class 2 CRISPR/Cas effector protein is a naturally-occurring protein (e.g., naturally occurs in prokaryotic cells). In other cases, the Class 2 CRISPR/Cas effector protein is not a naturally-occurring polypeptide (e.g., the Class 2 CRISPR/Cas effector protein is a variant effector protein, a chimeric protein, and the like).

Assays to determine whether given protein interacts with a CasY guide RNA can be any convenient binding assay that tests for binding between a protein and a nucleic acid. Suitable binding assays (e.g., gel shift assays) will be known to one of ordinary skill in the art (e.g., assays that include adding a CasY guide RNA and a protein to a target nucleic acid). Assays to determine whether a protein has an activity (e.g., to determine if the protein has nuclease activity that cleaves a target nucleic acid and/or some heterologous activity) can be any convenient assay (e.g., any convenient nucleic acid cleavage assay that tests for nucleic acid cleavage). Suitable assays (e.g., cleavage assays) will be known to one of ordinary skill in the art.

A naturally occurring CasY protein functions as an endonuclease that catalyzes a double strand break at a specific sequence in a targeted double stranded DNA (dsDNA). The sequence specificity is provided by the associated guide RNA, which hybridizes to a target sequence within the target DNA. The naturally occurring CasY guide RNA is a crRNA, where the crRNA includes (i) a guide sequence that hybridizes to a target sequence in the target DNA and (ii) a protein binding segment which includes a stem-loop (hairpin—dsRNA duplex) that binds to the CasY protein.

Figure 8:
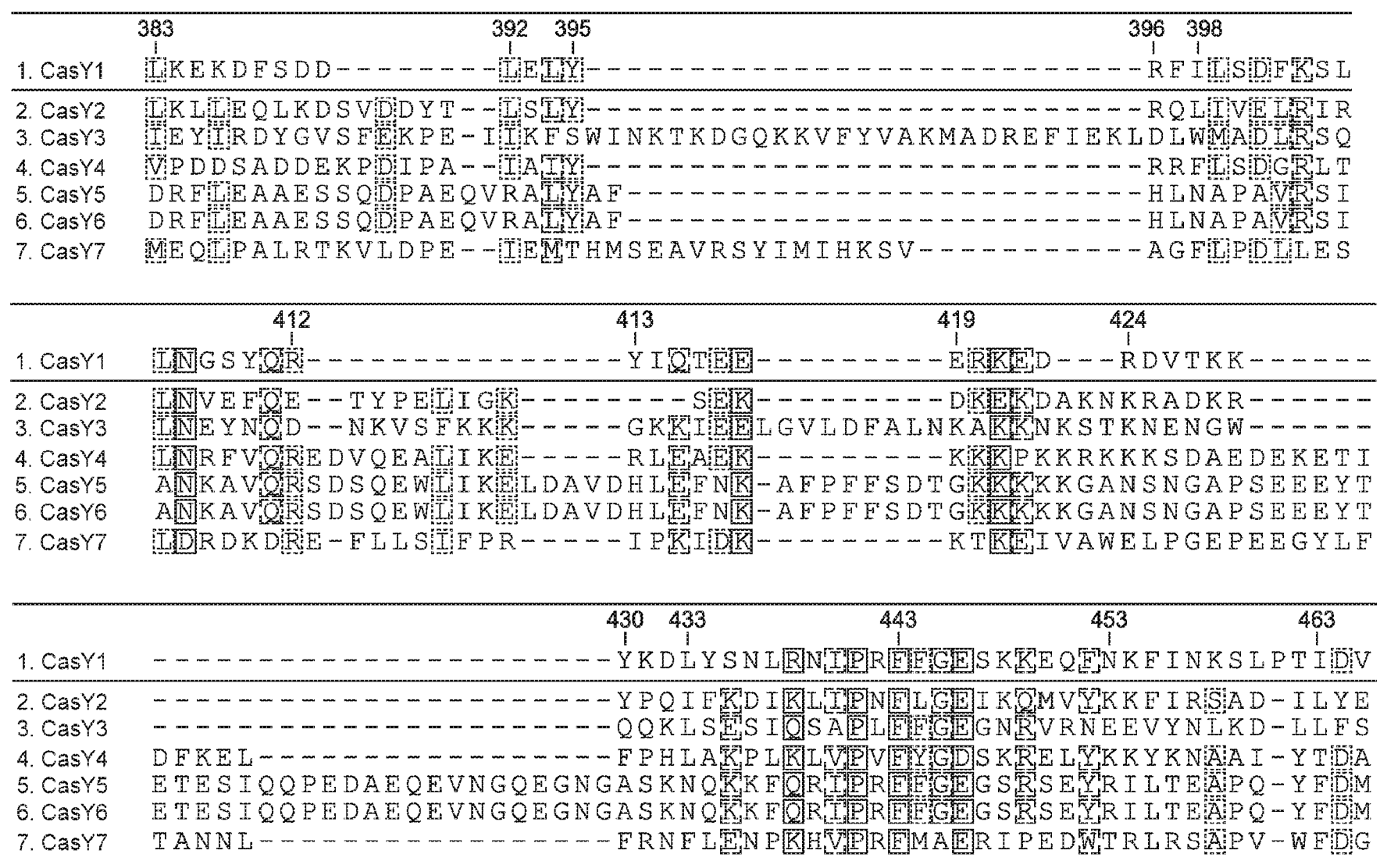

In some embodiments, the Class 2 CRISPR/Cas effector protein of the subject methods and/or compositions is (or is derived from) a naturally occurring (wild type) CasY protein. Examples of naturally occurring CasY proteins are depicted in FIG. 1. An alignment of example naturally occurring CasY proteins is presented in FIG. 8 (the proteins are labeled as "Y1.", "Y2.", "Y3.", etc.). It is important to note that CasY is short compared to previously identified CRISPR-Cas endonucleases, and thus use of this protein as an alternative provides the advantage that the nucleotide sequence encoding the protein is relatively short. This is useful, for example, in cases where a nucleic acid encoding the CasY protein is desirable, e.g., in situations that employ a viral vector (e.g., an AAV vector), for delivery to a cell such as a eukaryotic cell (e.g., mammalian cell, human cell, mouse cell, in vitro, ex vivo, in vivo) for research and/or clinical applications. It is also noted herein that bacteria harboring CasY CRISPR loci were present in environmental samples that were collected at low temperature (e.g., 10-17° C.). Thus, CasY is expected to be able to function well at low temperatures (e.g., 10-14° C., 10-17° C., 10-20° C.) (e.g., better than other Cas endoconucleases discovered to date).

In some cases, a Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the CasY1 protein sequence set forth in FIG. 1. For example, in some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the CasY1 protein sequence set forth in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the CasY1 protein sequence set forth in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the CasY1 protein sequence set forth in FIG. 1. In some cases, a Class 2 CRISPR/Cas effector protein includes an amino acid sequence having the CasY1 protein sequence set forth in FIG. 1. In some cases, a Class 2 CRISPR/Cas effector protein includes an amino acid sequence having the CasY1 protein sequence set forth in FIG. 1, with the exception that the sequence includes an amino acid substitution (e.g., 1, 2, or 3 amino acid substitutions) that reduces the naturally occurring catalytic activity of the protein (e.g., such as at amino acid positions described below).

In some cases, a Class 2 CRISPR/Cas effector protein includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the CasY2 protein sequence set forth in FIG. 1. In some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the CasY2 protein sequence set forth in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the CasY2 protein sequence set forth in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the CasY2 protein sequence set forth in FIG. 1. In some cases, a Class 2 CRISPR/Cas effector protein includes an amino acid sequence having the CasY2 protein sequence set forth in FIG. 1. In some cases, a Class 2 CRISPR/Cas effector protein includes an amino acid sequence having the CasY2 protein sequence set forth in FIG. 1, with the exception that the sequence includes an amino acid substitution (e.g., 1, 2, or 3 amino acid substitutions) that reduces the naturally occurring catalytic activity of the protein (e.g., such as at amino acid positions described below).

In some cases, a Class 2 CRISPR/Cas effector protein includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the CasY3 protein sequence set forth in FIG. 1. In some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the CasY3 protein sequence set forth in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the CasY3 protein sequence set forth in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the CasY3 protein sequence set forth in FIG. 1. In some cases, a Class 2 CRISPR/Cas effector protein includes an amino acid sequence having the CasY3 protein sequence set forth in FIG. 1. In some cases, a Class 2 CRISPR/Cas effector protein includes an amino acid sequence having the CasY3 protein sequence set forth in FIG. 1, with the exception that the sequence includes an amino acid substitution (e.g., 1, 2, or 3 amino acid substitutions) that reduces the naturally occurring catalytic activity of the protein (e.g., such as at amino acid positions described below).

In some cases, a Class 2 CRISPR/Cas effector protein includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the CasY4 protein sequence set forth in FIG. 1. In some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the CasY4 protein sequence set forth in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the CasY4 protein sequence set forth in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the CasY4 protein sequence set forth in FIG. 1. In some cases, a Class 2 CRISPR/Cas effector protein includes an amino acid sequence having the CasY4 protein sequence set forth in FIG. 1. In some cases, a Class 2 CRISPR/Cas effector protein includes an amino acid sequence having the CasY4 protein sequence set forth in FIG. 1, with the exception that the sequence includes an amino acid substitution (e.g., 1, 2, or 3 amino acid substitutions) that reduces the naturally occurring catalytic activity of the protein (e.g., such as at amino acid positions described below).

In some cases, a Class 2 CRISPR/Cas effector protein includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the CasY5 protein sequence set forth in FIG. 1. In some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the CasY5 protein sequence set forth in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the CasY5 protein sequence set forth in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the CasY5 protein sequence set forth in FIG. 1. In some cases, a Class 2 CRISPR/Cas effector protein includes an amino acid sequence having the CasY5 protein sequence set forth in FIG. 1. In some cases, a Class 2 CRISPR/Cas effector protein includes an amino acid sequence having the CasY5 protein sequence set forth in FIG. 1, with the exception that the sequence includes an amino acid substitution (e.g., 1, 2, or 3 amino acid substitutions) that reduces the naturally occurring catalytic activity of the protein (e.g., such as at amino acid positions described below).

In some cases, a Class 2 CRISPR/Cas effector protein includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the CasY6 protein sequence set forth in FIG. 1. In some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the CasY6 protein sequence set forth in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the CasY6 protein sequence set forth in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the CasY6 protein sequence set forth in FIG. 1. In some cases, a Class 2 CRISPR/Cas effector protein includes an amino acid sequence having the CasY6 protein sequence set forth in FIG. 1. In some cases, a Class 2 CRISPR/Cas effector protein includes an amino acid sequence having the CasY6 protein sequence set forth in FIG. 1, with the exception that the sequence includes an amino acid substitution (e.g., 1, 2, or 3 amino acid substitutions) that reduces the naturally occurring catalytic activity of the protein (e.g., such as at amino acid positions described below).

In some cases, a Class 2 CRISPR/Cas effector protein includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the CasY7 protein sequence set forth in FIG. 1. In some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the CasY7 protein sequence set forth in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the CasY7 protein sequence set forth in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the CasY7 protein sequence set forth in FIG. 1. In some cases, a Class 2 CRISPR/Cas effector protein includes an amino acid sequence having the CasY7 protein sequence set forth in FIG. 1. In some cases, a Class 2 CRISPR/Cas effector protein includes an amino acid sequence having the CasY7 protein sequence set forth in FIG. 1, with the exception that the sequence includes an amino acid substitution (e.g., 1, 2, or 3 amino acid substitutions) that reduces the naturally occurring catalytic activity of the protein (e.g., such as at amino acid positions described below).

In some cases, a Class 2 CRISPR/Cas effector protein includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the CasY18 protein sequence set forth in FIG. 1. In some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the CasY18 protein sequence set forth in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the CasY18 protein sequence set forth in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the CasY18 protein sequence set forth in FIG. 1. In some cases, a Class 2 CRISPR/Cas effector protein includes an amino acid sequence having the CasY18 protein sequence set forth in FIG. 1. In some cases, a Class 2 CRISPR/Cas effector protein includes an amino acid sequence having the CasY18 protein sequence set forth in FIG. 1, with the exception that the sequence includes an amino acid substitution (e.g., 1, 2, or 3 amino acid substitutions) that reduces the naturally occurring catalytic activity of the protein (e.g., such as at amino acid positions described below).

In some cases, a Class 2 CRISPR/Cas effector protein includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with any one of the CasY1, CasY2, CasY3, and CasY4 protein sequences set forth in FIG. 1. In some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with any one of the CasY1, CasY2, CasY3, and CasY4 protein sequences set forth in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with any one of the CasY1, CasY2, CasY3, and CasY4 protein sequences set forth in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with any one of the CasY1, CasY2, CasY3, and CasY4 protein sequences set forth in FIG. 1. In some cases, a Class 2 CRISPR/Cas effector protein includes an amino acid sequence having the CasY1, CasY2, CasY3, or CasY4 protein sequence set forth in FIG. 1. In some cases, a Class 2 CRISPR/Cas effector protein includes an amino acid sequence having the CasY1, CasY2, CasY3, or CasY4 protein sequence set forth in FIG. 1, with the exception that the sequence includes an amino acid substitution (e.g., 1, 2, or 3 amino acid substitutions) that reduces the naturally occurring catalytic activity of the protein (e.g., such as at amino acid positions described below).

In some cases, a Class 2 CRISPR/Cas effector protein includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with any one of the CasY1, CasY2, CasY3, CasY4, and CasY7 protein sequences set forth in FIG. 1. In some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with any one of the CasY1, CasY2, CasY3, CasY4, and CasY7 protein sequences set forth in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with any one of the CasY1, CasY2, CasY3, CasY4, and CasY7 protein sequences set forth in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with any one of the CasY1, CasY2, CasY3, CasY4, and CasY7 protein sequences set forth in FIG. 1. In some cases, a Class 2 CRISPR/Cas effector protein includes an amino acid sequence having the CasY1, CasY2, CasY3, CasY4, or CasY7 protein sequence set forth in FIG. 1. In some cases, a Class 2 CRISPR/Cas effector protein includes an amino acid sequence having the CasY1, CasY2, CasY3, CasY4, or CasY7 protein sequence set forth in FIG. 1, with the exception that the sequence includes an amino acid substitution (e.g., 1, 2, or 3 amino acid substitutions) that reduces the naturally occurring catalytic activity of the protein (e.g., such as at amino acid positions described below).

In some cases, a Class 2 CRISPR/Cas effector protein includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with any one of the CasY protein sequences set forth as CasY1, CasY2, CasY3, CasY4, CasY5, CasY6, or CasY7 in FIG. 1. In some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with any one of the CasY protein sequences set forth as CasY1, CasY2, CasY3, CasY4, CasY5, CasY6, or CasY7 in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with any one of the CasY protein sequences set forth as CasY1. CasY2, CasY3, CasY4, CasY5, CasY6, or CasY7 in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with any one of the CasY protein sequences set forth as CasY1, CasY2, CasY3, CasY4, CasY5, CasY6, or CasY7 in FIG. 1. In some cases, a Class 2 CRISPR/Cas effector protein includes an amino acid sequence having the CasY1, CasY2, CasY3, CasY4, CasY5, CasY6, or CasY7 protein sequence set forth in FIG. 1. In some cases, a Class 2 CRISPR/Cas effector protein includes an amino acid sequence having the CasY1, CasY2, CasY3, CasY4, CasY5, CasY6, or CasY7 protein sequence set forth in FIG. 1, with the exception that the sequence includes an amino acid substitution (e.g., 1, 2, or 3 amino acid substitutions) that reduces the naturally occurring catalytic activity of the protein (e.g., such as at amino acid positions described below).

In some cases, a Class 2 CRISPR/Cas effector protein includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with any one of the CasY protein sequences depicted in FIG. 1. In some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with any one of the CasY protein sequences depicted in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with any one of the CasY protein sequences depicted in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with any one of the CasY protein sequences depicted in FIG. 1. In some cases, a Class 2 CRISPR/Cas effector protein includes an amino acid sequence having the CasY1, CasY2, CasY3, CasY4, CasY5, CasY6, CasY7, or CasY18 protein sequence depicted in FIG. 1. In some cases, a Class 2 CRISPR/Cas effector protein includes an amino acid sequence having the CasY1, CasY2, CasY3, CasY4, CasY5, CasY6, CasY7, or CasY18 protein sequence depicted in FIG. 1, with the exception that the sequence includes an amino acid substitution (e.g., 1, 2, or 3 amino acid substitutions) that reduces the naturally occurring catalytic activity of the protein (e.g., such as at amino acid positions described below).

In some cases, a Class 2 CRISPR/Cas effector protein includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with any one of the CasY protein sequences depicted in FIG. 1. In some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with any one of the CasY protein sequences depicted in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with any one of the CasY protein sequences depicted in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with any one of the CasY protein sequences depicted in FIG. 1. In some cases, a Class 2 CRISPR/Cas effector protein includes an amino acid sequence having the CasY1, CasY2, CasY3, CasY4, CasY5, CasY6, CasY7, or CasY18 protein sequence depicted in FIG. 1. In some cases, a Class 2 CRISPR/Cas effector protein includes an amino acid sequence having the CasY1, CasY2, CasY3, CasY4, CasY5, CasY6, CasY7, or CasY18 protein sequence depicted in FIG. 1, with the exception that the sequence includes an amino acid substitution (e.g., 1, 2, or 3 amino acid substitutions) that reduces the naturally occurring catalytic activity of the protein (e.g., such as at amino acid positions described below).

CasY Protein Domains

Figure 9:
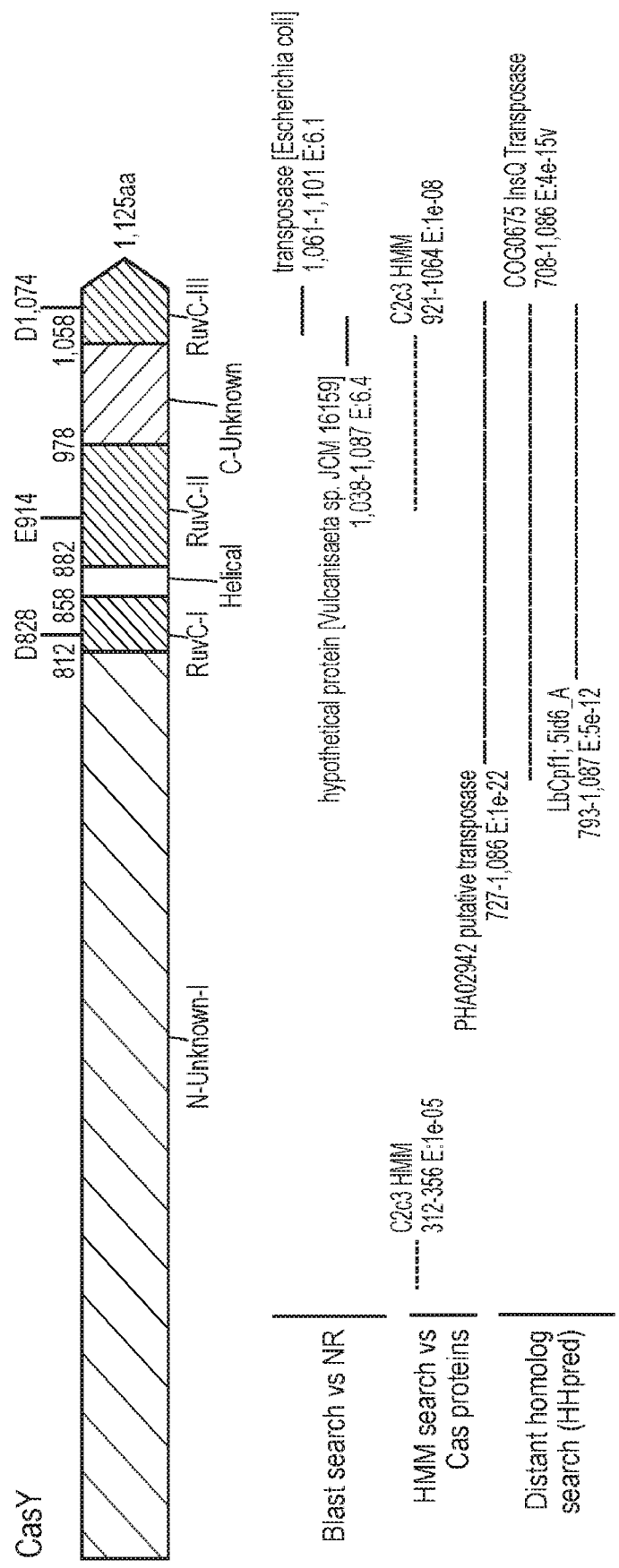
FIG. 9 (panels a-b): (panel a) depicts a schematic domain representation for CasY. Also shown are results from various searches attempting to identify homologs of CasY. (panel b) depicts portions of CasY-containing CRISPR loci.
Figure 9:
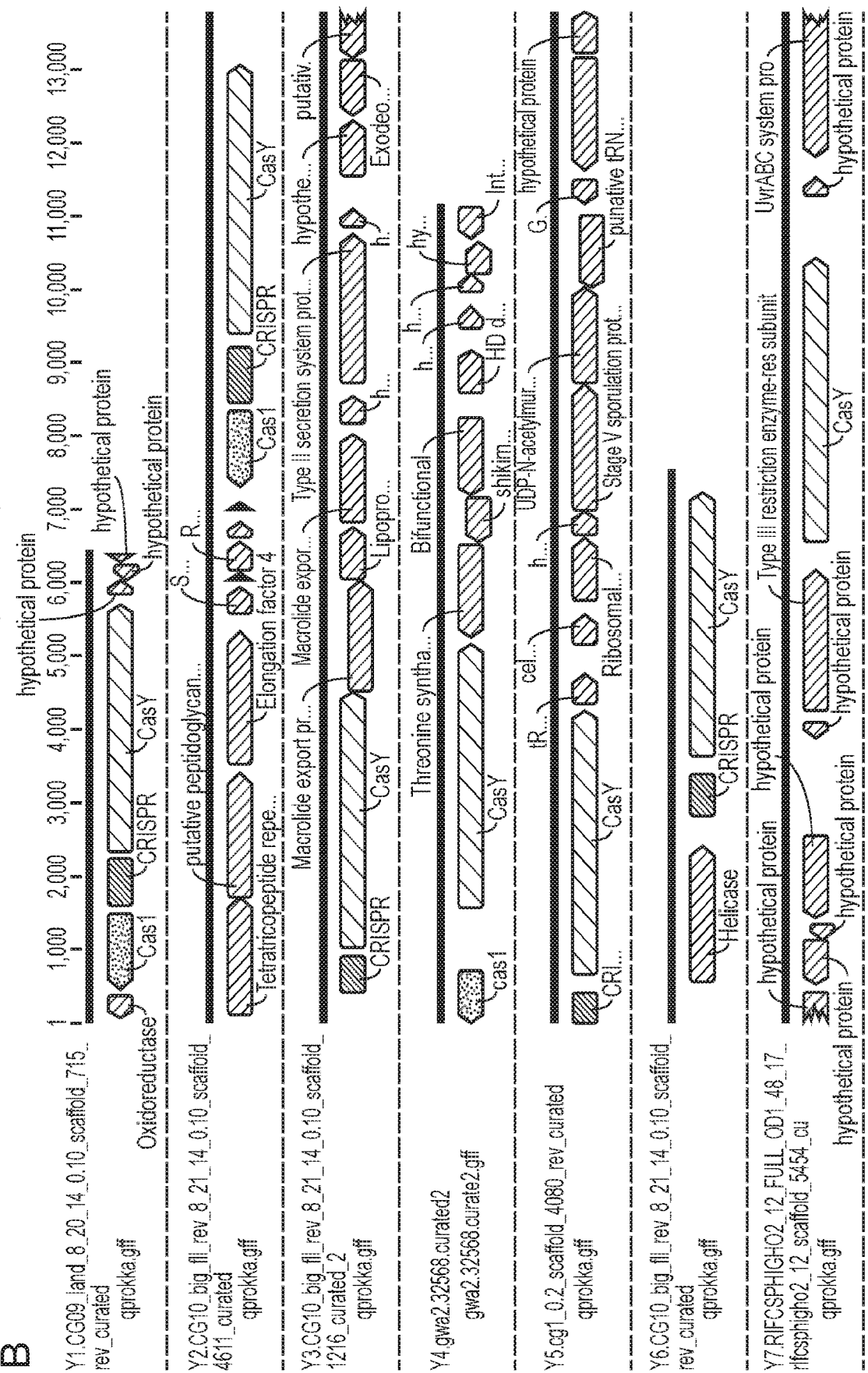

The domains of a CasY protein are depicted in FIG. 9. As can be seen in the schematic representation of FIG. 9 (amino acids are numbered based on the CasY1 protein of FIG. 1), a CasY protein includes an N-terminal domain roughly 800-1000 amino acids in length (e.g., about 815 for CasY1 and about 980 for CasY5), and a C-terminal domain that includes 3 partial RuvC domains (RuvC-I, RuvC-II, and RuvC-III, also referred to herein as subdomains) that are not contiguous with respect to the primary amino acid sequence of the CasY protein, but form a RuvC domain once the protein is produced and folds. Thus, in some cases, a Class 2 CRISPR/Cas effector protein (of the subject compositions and/or methods) includes an amino acid sequence with an N-terminal domain (e.g., not including any fused heterologous sequence such as an NLS and/or a domain with a catalytic activity) having a length in a range of from 750 to 1050 amino acids (e.g, from 750 to 1025, 750 to 1000, 750 to 950, 775 to 1050, 775 to 1025, 775 to 1000, 775 to 950, 800 to 1050, 800 to 1025, 800 to 1000, or 800 to 950 amino acids). In some cases, a Class 2 CRISPR/Cas effector protein (of the subject compositions and/or methods) includes an amino acid sequence having a length (e.g., not including any fused heterologous sequence such as an NLS and/or a domain with a catalytic activity) in a range of from 750 to 1050 amino acids (e.g, from 750 to 1025, 750 to 1000, 750 to 950, 775 to 1050, 775 to 1025, 775 to 1000, 775 to 950, 800 to 1050, 800 to 1025, 800 to 1000, or 800 to 950 amino acids) that is N-thermal to a split Ruv C domain (e.g., 3 partial RuvC domains—RuvC-I, RuvC-II, and RuvC-III).

In some cases, a Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of the CasY1 protein sequence set forth in FIG. 1. For example, in some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of the CasY1 protein sequence set forth in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of the CasY1 protein sequence set forth in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the N-terminal domain (e.g., the domain depicted as amino acids 1-812 for CasY1 in FIG. 9, panel a) of the CasY1 protein sequence set forth in FIG. 1. In some cases, a Class 2 CRISPR/Cas effector protein includes an amino acid sequence having amino acids 1-812 of the CasY1 protein sequence set forth in FIG. 1.

In some cases, a Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of the CasY1, CasY2, CasY3, or CasY4 protein sequence set forth in FIG. 1. For example, in some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of the CasY1, CasY2, CasY3, or CasY4 protein sequence set forth in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of the CasY1, CasY2, CasY3, or CasY4 protein sequence set forth in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the N-terminal domain (e.g., the domain depicted as amino acids 1-812 for CasY1 in FIG. 9, panel a) of the CasY1, CasY2, CasY3, or CasY4 protein sequence (amino acid sequence) set forth in FIG. 1. In some cases, a Class 2 CRISPR/Cas effector protein includes a fragment of the amino acid sequence of any one of the CasY1, CasY2, CasY3, and CasY4 protein sequences set forth in FIG. 1 that corresponds to amino acids 1-812 of the CasY1 protein sequence set forth in FIG. 1.

In some cases, a Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of the CasY1, CasY2, CasY3, CasY4, or CasY7 protein sequence set forth in FIG. 1. For example, in some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of the CasY1, CasY2, CasY3, CasY4, or CasY7 protein sequence set forth in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of the CasY1, CasY2, CasY3, CasY4, or CasY7 protein sequence set forth in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the N-terminal domain (e.g., the domain depicted as amino acids 1-812 for CasY1 in FIG. 9, panel a) of the CasY1, CasY2, CasY3, CasY4, or CasY7 protein sequence set forth in FIG. 1. In some cases, a Class 2 CRISPR/Cas effector protein includes a fragment of the amino acid sequence of any one of CasY1, CasY2, CasY3, CasY4, and CasY7 as depicted in FIG. 1 that corresponds to amino acids 1-812 of the CasY1 protein sequence set forth in FIG. 1.

In some cases, a Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of the CasY1, CasY2, CasY3, CasY4, CasY5, CasY6, CasY7, or CasY18 protein sequence set forth in FIG. 1. For example, in some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of the CasY1, CasY2, CasY3, CasY4, CasY5, CasY6, CasY7, or CasY18 protein sequence set forth in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of the CasY1, CasY2, CasY3, CasY4, CasY5, CasY6, CasY7, or CasY18 protein sequence set forth in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the N-terminal domain (e.g., the domain depicted as amino acids 1-812 for CasY1 in FIG. 9, panel a) of the CasY1, CasY2, CasY3, CasY4, CasY5, CasY6, CasY7, or CasY18 protein sequence set forth in FIG. 1. In some cases, a Class 2 CRISPR/Cas effector protein includes a fragment of the amino acid sequence of any one of the CasY1, CasY2, CasY3, CasY4, CasY5, CasY6, CasY7, and CasY18 protein sequences depicted in FIG. 1 that corresponds to amino acids 1-812 of the CasY1 protein sequence set forth in FIG. 1.

In some cases, a Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of the CasY1, CasY2, CasY3, CasY4, CasY5, CasY6, CasY7, or CasY18 protein sequence set forth in FIG. 1. For example, in some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of the CasY1, CasY2, CasY3, CasY4, CasY5, CasY6, CasY7, or CasY18 protein sequence set forth in FIG. 1. In some cases, a Class 2 CRISPR/Cas effector protein includes an amino acid sequence having 80% or more sequence identity (e.g., 85% or more. 90% or more, 95% or more, 97% or more, 98% or more, 99% or more, or 100% sequence identity) with the N-terminal domain (e.g., the domain depicted as amino acids 1-812 for CasY1 in FIG. 9, panel a) of the CasY1, CasY2, CasY3, CasY4, CasY5, CasY6, CasY7, or CasY18 protein sequence set forth in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the N-terminal domain (e.g., the domain depicted as amino acids 1-812 for CasY1 in FIG. 9, panel a) of the CasY1, CasY2, CasY3, CasY4, CasY5, CasY6, CasY7, or CasY18 protein sequence set forth in FIG. 1. In some cases, a Class 2 CRISPR/Cas effector protein includes a fragment of the amino acid sequence of any one of the CasY1, CasY2, CasY3, CasY4, CasY5, CasY6, CasY7, and CasY18 protein sequences depicted in FIG. 1 that corresponds to amino acids 1-812 of the CasY1 protein sequence set forth in FIG. 1.

In some cases, a Class 2 CRISPR/Cas effector protein (of the subject compositions and/or methods) includes a first amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY1, CasY2, CasY3, and CasY4 protein sequences set forth in FIG. 1; and a second amino acid sequence, C-terminal to the first amino acid sequence, that includes a split Ruv C domain (e.g., 3 partial RuvC domains—RuvC-I, RuvC-II, and RuvC-III). For example, in some cases, a Class 2 CRISPR/Cas effector protein includes a first amino acid sequence having 50% or more sequence identity (e.g., 60% or more, 70% or more, 80% or more, 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY1, CasY2, CasY3, and CasY4 protein sequences set forth in FIG. 1; and a second amino acid sequence, C-terminal to the first amino acid sequence, that includes a split Ruv C domain (e.g., 3 partial RuvC domains—RuvC-I, RuvC-II, and RuvC-III). In some cases, a Class 2 CRISPR/Cas effector protein includes a first amino acid sequence having 80% or more sequence identity (e.g., 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY1, CasY2, CasY3, and CasY4 protein sequences set forth in FIG. 1; and a second amino acid sequence, C-terminal to the first amino acid sequence, that includes a split Ruv C domain (e.g., 3 partial RuvC domains—RuvC-I, RuvC-II, and RuvC-III). In some cases, a Class 2 CRISPR/Cas effector protein includes a first amino acid sequence having 90% or more sequence identity (e.g., 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY1, CasY2, CasY3, and CasY4 protein sequences set forth in FIG. 1; and a second amino acid sequence, C-terminal to the first amino acid sequence, that includes a split Ruv C domain (e.g., 3 partial RuvC domains—RuvC-I, RuvC-II, and RuvC-III). In some cases, a Class 2 CRISPR/Cas effector protein includes an amino acid sequence corresponding to amino acids 1-812 of the CasY1 protein sequence set forth in FIG. 1; and a second amino acid sequence, C-terminal to the first amino acid sequence, that includes a split Ruv C domain (e.g., 3 partial RuvC domains—RuvC-I, RuvC-II, and RuvC-III). In some cases, a Class 2 CRISPR/Cas effector protein (of the subject compositions and/or methods) includes a first amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY1, CasY2, CasY3, CasY4, and CasY7 protein sequences set forth in FIG. 1; and a second amino acid sequence, C-terminal to the first amino acid sequence, that includes a split Ruv C domain (e.g., 3 partial RuvC domains—RuvC-I, RuvC-II, and RuvC-III). For example, in some cases, a Class 2 CRISPR/Cas effector protein includes a first amino acid sequence having 50% or more sequence identity (e.g., 60% or more, 70% or more, 80% or more, 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY1, CasY2, CasY3, CasY4, and CasY7 protein sequences set forth in FIG. 1; and a second amino acid sequence, C-terminal to the first amino acid sequence, that includes a split Ruv C domain (e.g., 3 partial RuvC domains—RuvC-I, RuvC-II, and RuvC-III). In some cases, a Class 2 CRISPR/Cas effector protein includes a first amino acid sequence having 80% or more sequence identity (e.g., 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY1, CasY2, CasY3, CasY4, and CasY7 protein sequences set forth in FIG. 1; and a second amino acid sequence, C-terminal to the first amino acid sequence, that includes a split Ruv C domain (e.g., 3 partial RuvC domains—RuvC-I, RuvC-II, and RuvC-III). In some cases, a Class 2 CRISPR/Cas effector protein includes a first amino acid sequence having 90% or more sequence identity (e.g., 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY1, CasY2, CasY3, CasY4, and CasY7 protein sequences set forth in FIG. 1; and a second amino acid sequence, C-terminal to the first amino acid sequence, that includes a split Ruv C domain (e.g., 3 partial RuvC domains—RuvC-1, RuvC-11, and RuvC-111). In some cases, a Class 2 CRISPR/Cas effector protein includes an amino acid sequence corresponding to amino acids 1-812 of the CasY1 protein sequence set forth in FIG. 1; and a second amino acid sequence, C-terminal to the first amino acid sequence, that includes a split Ruv C domain (e.g., 3 partial RuvC domains—RuvC-I, RuvC-II, and RuvC-III).

In some cases, a Class 2 CRISPR/Cas effector protein (of the subject compositions and/or methods) includes a first amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the N-terminal domain (e.g., the domain depicted as amino acids 1-812 for Cas Y1 in FIG. 9, panel a) of any one of the CasY protein sequences depicted in FIG. 1; and a second amino acid sequence, C-terminal to the first amino acid sequence, that includes a split Ruv C domain (e.g., 3 partial RuvC domains—RuvC-I, RuvC-II, and RuvC-III). For example, in some cases, a Class 2 CRISPR/Cas effector protein includes a first amino acid sequence having 50% or more sequence identity (e.g., 60% or more, 70% or more, 80% or more, 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY protein sequences depicted in FIG. 1; and a second amino acid sequence, C-terminal to the first amino acid sequence, that includes a split Ruv C domain (e.g., 3 partial RuvC domains—RuvC-I, RuvC-II, and RuvC-III). In some cases, a Class 2 CRISPR/Cas effector protein includes a first amino acid sequence having 80% or more sequence identity (e.g., 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY protein sequences depicted in FIG. 1; and a second amino acid sequence, C-terminal to the first amino acid sequence, that includes a split Ruv C domain (e.g., 3 partial RuvC domains—RuvC-I, RuvC-II, and RuvC-III). In some cases, a Class 2 CRISPR/Cas effector protein includes a first amino acid sequence having 90% or more sequence identity (e.g., 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY protein sequences depicted in FIG. 1; and a second amino acid sequence, C-terminal to the first amino acid sequence, that includes a split Ruv C domain (e.g., 3 partial RuvC domains—RuvC-I, RuvC-II, and RuvC-III). In some cases, a Class 2 CRISPR/Cas effector protein includes an amino acid sequence corresponding to amino acids 1-812 of the CasY1 protein sequence set forth in FIG. 1; and a second amino acid sequence, C-terminal to the first amino acid sequence, that includes a split Ruv C domain (e.g., 3 partial RuvC domains—RuvC-I, RuvC-II, and RuvC-III).

In some cases, a Class 2 CRISPR/Cas effector protein (of the subject compositions and/or methods) includes a first amino acid sequence having 20% or more sequence identity (e.g., 30% or more, 40% or more, 50% or more, 60% or more, 70% or more, 80% or more, 85% or more. 90% or more, 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY1, CasY2, CasY3, CasY4, CasY5, CasY6, CasY7, and CasY18 protein sequences depicted in FIG. 1; and a second amino acid sequence, C-terminal to the first amino acid sequence, that includes a split Ruv C domain (e.g., 3 partial RuvC domains—RuvC-I, RuvC-II, and RuvC-III). For example, in some cases, a Class 2 CRISPR/Cas effector protein includes a first amino acid sequence having 50% or more sequence identity (e.g., 60% or more, 70% or more, 80% or more, 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY1, CasY2, CasY3, CasY4, CasY5, CasY6, CasY7, and CasY18 protein sequences depicted in FIG. 1; and a second amino acid sequence, C-terminal to the first amino acid sequence, that includes a split Ruv C domain (e.g., 3 partial RuvC domains—RuvC-I, RuvC-II, and RuvC-III). In some cases, a Class 2 CRISPR/Cas effector protein includes a first amino acid sequence having 80% or more sequence identity (e.g., 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY1, CasY2, CasY3, CasY4, CasY5, CasY6, CasY7, and CasY18 protein sequences depicted in FIG. 1; and a second amino acid sequence, C-terminal to the first amino acid sequence, that includes a split Ruv C domain (e.g., 3 partial RuvC domains—RuvC-I, RuvC-II, and RuvC-III). In some cases, a Class 2 CRISPR/Cas effector protein includes a first amino acid sequence having 90% or more sequence identity (e.g., 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY1, CasY2, CasY3, CasY4, CasY5, CasY6, CasY7, and CasY18 protein sequences depicted in FIG. 1; and a second amino acid sequence, C-terminal to the first amino acid sequence, that includes a split Ruv C domain (e.g., 3 partial RuvC domains—RuvC-I, RuvC-II, and RuvC-III). In some cases, a Class 2 CRISPR/Cas effector protein includes an amino acid sequence corresponding to amino acids 1-812 of the CasY1 protein sequence set forth in FIG. 1; and a second amino acid sequence, C-terminal to the first amino acid sequence, that includes a split Ruv C domain (e.g., 3 partial RuvC domains—RuvC-I, RuvC-II, and RuvC-III).

In some embodiments, the split RuvC domain of a CasY protein (of the subject compositions and/or methods) includes a region between the RuvC-II and RuvC-III subdomains that is larger than the RuvC-III subdomain. For example, in some cases, the ratio of the length of the region between the RuvC-II and RuvC-III subdomains over the length of the RuvC-III subdomain is 1.1 or greater (e.g., 1.2). In some cases, the ratio of the length of the region between the RuvC-II and RuvC-III subdomains over the length of the RuvC-III subdomain is greater than 1). In some cases, the ratio of the length of the region between the RuvC-II and RuvC-III subdomains over the length of the RuvC-III subdomain is greater than l and between 1 and 1.5 (e.g., 1 and 1.4, 1 and 1.3, or 1 and 1.2).

In some embodiments (for a CasY protein of the subject compositions and/or methods), the ratio of the length of the RuvC-II subdomain over the length of the RuvC-III subdomain is 2 or less (e.g., 1.8 or less, 1.7 or less, 1.6 or less, 1.5 or less, or 1.4 or less). For example, in some cases, the ratio of the length of the RuvC-II subdomain over the length of the RuvC-III subdomain is 1.5 or less (e.g., 1.4 or less). In some embodiments, the ratio of the length of the RuvC-11 subdomain over the length of the RuvC-III subdomain is in a range of from 1 to 2 (e.g., from 1.1 to 2, 1.2 to 2, 1 to 1.8, 1.1 to 1.8, 1.2 to 1.8, 1 to 1.6, 1.1 to 1.6, 1.2 to 1.6, 1 to 14, 1.1 to 1.4, or 1.2 to 1.4).

In some cases (for a CasY protein of the subject compositions and/or methods), the ratio of the length of the region between the RuvC-II and RuvC-III subdomains over the length of the RuvC-III subdomain is greater than 1. In some cases, the ratio of the length of the region between the RuvC-II and RuvC-III subdomains over the length of the RuvC-III subdomain is greater than 1 and between 1 and 1.3 (e.g., 1 and 1.2).

In some cases (for a CasY protein of the subject compositions and/or methods), the region between the RuvC-11 and RuvC-111 subdomains is at least 60 amino acids in length (e.g., at least 65, 68, or 70 amino acids in length). In some cases, the region between the RuvC-TT and RuvC-III subdomains has a length in a range of from 60-110 amino acids (e.g., a range of from 60-105, 60-100, 60-95, 60-90, 65-110, 65-105, 65-100, 65-95, or 65-90 amino acids).

In some cases, a Class 2 CRISPR/Cas effector protein (of the subject compositions and/or methods) includes a first amino acid sequence having 50% or more sequence identity (e.g., 60% or more, 70% or more, 80% or more, 85% or more, 90% or more, 95% or more, 97% or more. 98% or more, 99% or more, or 100% sequence identity) with the N-terminal domain (e.g., the domain depicted as amino acids 1-812 for CasY1 in FIG. 9, panel a) of any one of the CasY1, CasY2, CasY3, and CasY4 protein sequences set forth in FIG. 1; and a second amino acid sequence, C-terminal to the first amino acid sequence, that includes 3 partial RuvC domains—RuvC-I, RuvC-II, and RuvC-III—where: (i) the ratio of the length of the region between the RuvC-II and RuvC-III subdomains over the length of the RuvC-III subdomain is 1.1 or greater (e.g., 1.2); (ii) the ratio of the length of the region between the RuvC-II and RuvC-III subdomains over the length of the RuvC-III subdomain is greater than 1; (iii) the ratio of the length of the region between the RuvC-II and RuvC-III subdomains over the length of the RuvC-III subdomain is greater than land between 1 and 1.5 (e.g., 1 and 1.4, 1 and 1.3, 1 and 1.2); (iv) the ratio of the length of the RuvC-II subdomain over the length of the RuvC-III subdomain is 2 or less (e.g., 1.8 or less, 1.7 or less, 1.6 or less, 1.5 or less, or 1.4 or less); (v) the ratio of the length of the RuvC-II subdomain over the length of the RuvC-III subdomain is 1.5 or less (e.g., 1.4 or less); (vi) the ratio of the length of the RuvC-II subdomain over the length of the RuvC-III subdomain is in a range of from 1 to 2 (e.g., from 1.1 to 2, 1.2 to 2, 1 to 1.8, 1.1 to 1.8, 1.2 to 1.8, 1 to 1.6, 1.1 to 1.6, 1.2 to 1.6, 1 to 14, 1.1 to 1.4, or 1.2 to 1.4); (vii) the ratio of the length of the region between the RuvC-II and RuvC-III subdomains over the length of the RuvC-III subdomain is greater than 1; (viii) the ratio of the length of the region between the RuvC-II and RuvC-III subdomains over the length of the RuvC-III subdomain is greater than land between 1 and 1.5 (e.g., 1 and 1.2); (ix) the region between the RuvC-II and RuvC-III subdomains is at least 60 amino acids in length (e.g., at least 65 or at least 70 amino acids in length); (x) the region between the RuvC-II and RuvC-III subdomains is at least 65 amino acids in length; (xi) the region between the RuvC-II and RuvC-III subdomains has a length in a range of from 60-110 amino acids (e.g., a range of from 60-105, 60-100, 60-95, 60-90, 65-110, 65-105, 65-100, 65-95, or 65-90 amino acids); or (xii) the region between the RuvC-II and RuvC-III subdomains has a length in a range of from 65-95 amino acids.

In some cases, a Class 2 CRISPR/Cas effector protein (of the subject compositions and/or methods) includes a first amino acid sequence having 75% or more sequence identity (e.g., 80% or more, 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY1, CasY2, CasY3, and CasY4 protein sequences set forth in FIG. 1; and a second amino acid sequence, C-terminal to the first amino acid sequence, that includes 3 partial RuvC domains—RuvC-I, RuvC-II, and RuvC-III—where: (i) the ratio of the length of the region between the RuvC-II and RuvC-III subdomains over the length of the RuvC-III subdomain is 1.1 or greater (e.g., 1.2); (ii) the ratio of the length of the region between the RuvC-II and RuvC-III subdomains over the length of the RuvC-III subdomain is greater than 1; (iii) the ratio of the length of the region between the RuvC-II and RuvC-III subdomains over the length of the RuvC-III subdomain is greater than land between 1 and 1.5 (e.g., 1 and 1.4, 1 and 1.3, 1 and 1.2); (iv) the ratio of the length of the RuvC-II subdomain over the length of the RuvC-III subdomain is 2 or less (e.g., 1.8 or less, 1.7 or less, 1.6 or less, 1.5 or less, or 1.4 or less); (v) the ratio of the length of the RuvC-II subdomain over the length of the RuvC-III subdomain is 1.5 or less (e.g., 1.4 or less); (vi) the ratio of the length of the RuvC-II subdomain over the length of the RuvC-III subdomain is in a range of from 1 to 2 (e.g., from 1.1 to 2, 1.2 to 2, 1 to 1.8, 1.1 to 1.8, 1.2 to 1.8, 1 to 1.6, 1.1 to 1.6, 1.2 to 1.6, 1 to 14, 1.1 to 1.4, In some cases, a Class 2 CRISPR/Cas effector protein (of the subject compositions and/or methods) includes a first amino acid sequence having 85% or more sequence identity (e.g., 90% or more, 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY1, CasY2, CasY3, and CasY4 protein sequences set forth in FIG. 1; and a second amino acid sequence, C-terminal to the first amino acid sequence, that includes 3 partial RuvC domains—RuvC-I, RuvC-II, and RuvC-III—where: (i) the ratio of the length of the region between the RuvC-II and RuvC-III subdomains over the length of the RuvC-III subdomain is 1.1 or greater (e.g., 1.2); (ii) the ratio of the length of the region between the RuvC-11 and RuvC-111 subdomains over the length of the RuvC-TIT subdomain is greater than 1; (iii) the ratio of the length of the region between the RuvC-II and RuvC-III subdomains over the length of the RuvC-III subdomain is greater than land between 1 and 1.5 (e.g., 1 and 1.4, 1 and 1.3, 1 and 1.2); (iv) the ratio of the length of the RuvC-II subdomain over the length of the RuvC-III subdomain is 2 or less (e.g., 1.8 or less, 1.7 or less, 1.6 or less, 1.5 or less, or 1.4 or less); (v) the ratio of the length of the RuvC-II subdomain over the length of the RuvC-III subdomain is 1.5 or less (e.g., 1.4 or less); (vi) the ratio of the length of the RuvC-II subdomain over the length of the RuvC-III subdomain is in a range of from 1 to 2 (e.g., from 1.1 to 2, 1.2 to 2, 1 to 1.8, 1.1 to 1.8, 1.2 to 1.8, 1 to 1.6, 1.1 to 1.6, 1.2 to 1.6, 1 to 14, 1.1 to 1.4, or 1.2 to 1.4); (vii) the ratio of the length of the region between the RuvC-II and RuvC-III subdomains over the length of the RuvC-III subdomain is greater than 1; (viii) the ratio of the length of the region between the RuvC-II and RuvC-III subdomains over the length of the RuvC-III subdomain is greater than land between 1 and 1.5 (e.g., 1 and 1.2); (ix) the region between the RuvC-II and RuvC-III subdomains is at least 60 amino acids in length (e.g., at least 65 or at least 70 amino acids in length); (x) the region between the RuvC-II and RuvC-III subdomains is at least 65 amino acids in length; (xi) the region between the RuvC-II and RuvC-III subdomains has a length in a range of from 60-110 amino acids (e.g., a range of from 60-105, 60-100, 60-95, 60-90, 65-110, 65-105, 65-100, 65-95, or 65-90 amino acids); or (xii) the region between the RuvC-II and RuvC-III subdomains has a length in a range of from 65-95 amino acids.

In some cases, a Class 2 CRISPR/Cas effector protein (of the subject compositions and/or methods) includes a first amino acid sequence having 50% or more sequence identity (e.g., 60% or more, 70% or more, 80% or more, 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY1, CasY2, CasY3, CasY4, and CasY7 protein sequences set forth in FIG. 1; and a second amino acid sequence, C-terminal to the first amino acid sequence, that includes 3 partial RuvC domains—RuvC-I, RuvC-II, and RuvC-III—where: (i) the ratio of the length of the region between the RuvC-II and RuvC-III subdomains over the length of the RuvC-III subdomain is 1.1 or greater (e.g., 1.2); (ii) the ratio of the length of the region between the RuvC-II and RuvC-III subdomains over the length of the RuvC-III subdomain is greater than 1; (iii) the ratio of the length of the region between the RuvC-II and RuvC-III subdomains over the length of the RuvC-III subdomain is greater than land between 1 and 1.5 (e.g., 1 and 1.4, 1 and 1.3, 1 and 1.2); (iv) the ratio of the length of the RuvC-II subdomain over the length of the RuvC-III subdomain is 2 or less (e.g., 1.8 or less, 1.7 or less, 1.6 or less, 1.5 or less, or 1.4 or less); (v) the ratio of the length of the RuvC-II subdomain over the length of the RuvC-III subdomain is 1.5 or less (e.g., 1.4 or less); (vi) the ratio of the length of the RuvC-II subdomain over the length of the RuvC-III subdomain is in a range of from 1 to 2 (e.g., from 1.1 to 2, 1.2 to 2, 1 to 1.8, 1.1 to 1.8, 1.2 to 1.8, 1 to 1.6, 1.1 to 1.6, 1.2 to 1.6, 1 to 14, 1.1 to 1.4, or 1.2 to 1.4); (vii) the ratio of the length of the region between the RuvC-II and RuvC-III subdomains over the length of the RuvC-III subdomain is greater than 1; (viii) the ratio of the length of the region between the RuvC-II and RuvC-III subdomains over the length of the RuvC-III subdomain is greater than land between 1 and 1.5 (e.g., 1 and 1.2); (ix) the region between the RuvC-II and RuvC-III subdomains is at least 60 amino acids in length (e.g., at least 65 or at least 70 amino acids in length); (x) the region between the RuvC-II and RuvC-III subdomains is at least 65 amino acids in length; (xi) the region between the RuvC-II and RuvC-III subdomains has a length in a range of from 60-110 amino acids (e.g., a range of from 60-105, 60-100, 60-95, 60-90, 65-110, 65-105, 65-100, 65-95, or 65-90 amino acids); or (xii) the region between the RuvC-II and RuvC-III subdomains has a length in a range of from 65-95 amino acids.

In some cases, a Class 2 CRISPR/Cas effector protein (of the subject compositions and/or methods) includes a first amino acid sequence having 75% or more sequence identity (e.g., 80% or more, 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY1, CasY2, CasY3, CasY4, and CasY7 protein sequences set forth in FIG. 1; and a second amino acid sequence, C-terminal to the first amino acid sequence, that includes 3 partial RuvC domains—RuvC-I, RuvC-II, and RuvC-III—where: (i) the ratio of the length of the region between the RuvC-II and RuvC-III subdomains over the length of the RuvC-III subdomain is 1.1 or greater (e.g., 1.2); (ii) the ratio of the length of the region between the RuvC-II and RuvC-III subdomains over the length of the RuvC-III subdomain is greater than 1; (iii) the ratio of the length of the region between the RuvC-II and RuvC-III subdomains over the length of the RuvC-III subdomain is greater than land between 1 and 1.5 (e.g., 1 and 1.4, 1 and 1.3, 1 and 1.2); (iv) the ratio of the length of the RuvC-II subdomain over the length of the RuvC-III subdomain is 2 or less (e.g., 1.8 or less, 1.7 or less, 1.6 or less, 1.5 or less, or 1.4 or less); (v) the ratio of the length of the RuvC-II subdomain over the length of the RuvC-III subdomain is 1.5 or less (e.g., 1.4 or less); (vi) the ratio of the length of the RuvC-II subdomain over the length of the RuvC-III subdomain is in a range of from 1 to 2 (e.g., from 1.1 to 2, 1.2 to 2, 1 to 1.8, 1.1 to 1.8, 1.2 to 1.8, 1 to 1.6, 1.1 to 1.6, 1.2 to 1.6, 1 to 14, 1.1 to 1.4, or 1.2 to 1.4); (vii) the ratio of the length of the region between the RuvC-II and RuvC-III subdomains over the length of the RuvC-III subdomain is greater than 1; (viii) the ratio of the length of the region between the RuvC-II and RuvC-III subdomains over the length of the RuvC-III subdomain is greater than land between 1 and 1.5 (e.g., 1 and 1.2); (ix) the region between the RuvC-II and RuvC-III subdomains is at least 60 amino acids in length (e.g., at least 65 or at least 70 amino acids in length); (x) the region between the RuvC-II and RuvC-III subdomains is at least 65 amino acids in length; (xi) the region between the RuvC-II and RuvC-III subdomains has a length in a range of from 60-110 amino acids (e.g., a range of from 60-105, 60-100, 60-95, 60-90, 65-110, 65-105, 65-100, 65-95, or 65-90 amino acids); or (xii) the region between the RuvC-II and RuvC-III subdomains has a length in a range of from 65-95 amino acids.

In some cases, a Class 2 CRISPR/Cas effector protein (of the subject compositions and/or methods) includes a first amino acid sequence having 85% or more sequence identity (e.g., 90% or more, 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY1, CasY2, CasY3, CasY4, and CasY7 protein sequences set forth in FIG. 1; and a second amino acid sequence, C-terminal to the first amino acid sequence, that includes 3 partial RuvC domains—RuvC-I, RuvC-II, and RuvC-III—where: (i) the ratio of the length of the region between the RuvC-II and RuvC-III subdomains over the length of the RuvC-III subdomain is 1.1 or greater (e.g., 1.2); (ii) the ratio of the length of the region between the RuvC-II and RuvC-III subdomains over the length of the RuvC-III subdomain is greater than 1; (iii) the ratio of the length of the region between the RuvC-II and RuvC-III subdomains over the length of the RuvC-III subdomain is greater than land between 1 and 1.5 (e.g., 1 and 1.4, 1 and 1.3, 1 and 1.2); (iv) the ratio of the length of the RuvC-II subdomain over the length of the RuvC-III subdomain is 2 or less (e.g., 1.8 or less, 1.7 or less, 1.6 or less, 1.5 or less, or 1.4 or less); (v) the ratio of the length of the RuvC-II subdomain over the length of the RuvC-III subdomain is 1.5 or less (e.g., 1.4 or less); (vi) the ratio of the length of the RuvC-II subdomain over the length of the RuvC-III subdomain is in a range of from 1 to 2 (e.g., from 1.1 to 2, 1.2 to 2, 1 to 1.8, 1.1 to 1.8, 1.2 to 1.8, 1 to 1.6, 1.1 to 1.6, 1.2 to 1.6, 1 to 14, 1.1 to 1.4, or 1.2 to 1.4); (vii) the ratio of the length of the region between the RuvC-II and RuvC-III subdomains over the length of the RuvC-III subdomain is greater than 1; (viii) the ratio of the length of the region between the RuvC-II and RuvC-III subdomains over the length of the RuvC-III subdomain is greater than land between 1 and 1.5 (e.g., 1 and 1.2); (ix) the region between the RuvC-II and RuvC-III subdomains is at least 60 amino acids in length (e.g., at least 65 or at least 70 amino acids in length); (x) the region between the RuvC-II and RuvC-III subdomains is at least 65 amino acids in length; (xi) the region between the RuvC-II and RuvC-III subdomains has a length in a range of from 60-110 amino acids (e.g., a range of from 60-105, 60-100, 60-95, 60-90, 65-110, 65-105, 65-100, 65-95, or 65-90 amino acids); or (xii) the region between the RuvC-II and RuvC-III subdomains has a length in a range of from 65-95 amino acids.

In some cases, a Class 2 CRISPR/Cas effector protein (of the subject compositions and/or methods) includes a first amino acid sequence having 50% or more sequence identity (e.g., 60% or more, 70% or more, 80% or more, 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY1, CasY2, CasY3, CasY4, CasY5, CasY6, CasY7, and CasY18 protein sequences depicted in FIG. 1; and a second amino acid sequence, C-terminal to the first amino acid sequence, that includes 3 partial RuvC domains—RuvC-I, RuvC-11, and RuvC-111—where: (i) the ratio of the length of the region between the RuvC-11 and RuvC-III subdomains over the length of the RuvC-III subdomain is 1.1 or greater (e.g., 1.2); (ii) the ratio of the length of the region between the RuvC-II and RuvC-III subdomains over the length of the RuvC-III subdomain is greater than 1; (iii) the ratio of the length of the region between the RuvC-II and RuvC-III subdomains over the length of the RuvC-III subdomain is greater than land between 1 and 1.5 (e.g., 1 and 1.4, 1 and 1.3, 1 and 1.2); (iv) the ratio of the length of the RuvC-II subdomain over the length of the RuvC-III subdomain is 2 or less (e.g., 1.8 or less, 1.7 or less, 1.6 or less, 1.5 or less, or 1.4 or less); (v) the ratio of the length of the RuvC-II subdomain over the length of the RuvC-III subdomain is 1.5 or less (e.g., 1.4 or less); (vi) the ratio of the length of the RuvC-II subdomain over the length of the RuvC-III subdomain is in a range of from 1 to 2 (e.g., from 1.1 to 2, 1.2 to 2, 1 to 1.8, 1.1 to 1.8, 1.2 to 1.8, 1 to 1.6, 1.1 to 1.6, 1.2 to 1.6, 1 to 14, 1.1 to 1.4, or 1.2 to 1.4); (vii) the ratio of the length of the region between the RuvC-II and RuvC-III subdomains over the length of the RuvC-III subdomain is greater than 1; (viii) the ratio of the length of the region between the RuvC-II and RuvC-III subdomains over the length of the RuvC-III subdomain is greater than land between 1 and 1.5 (e.g., 1 and 1.2); (ix) the region between the RuvC-II and RuvC-III subdomains is at least 60 amino acids in length (e.g., at least 65 or at least 70 amino acids in length); (x) the region between the RuvC-II and RuvC-III subdomains is at least 65 amino acids in length; (xi) the region between the RuvC-II and RuvC-III subdomains has a length in a range of from 60-110 amino acids (e.g., a range of from 60-105, 60-100, 60-95, 60-90, 65-110, 65-105, 65-100, 65-95, or 65-90 amino acids); or (xii) the region between the RuvC-II and RuvC-III subdomains has a length in a range of from 65-95 amino acids.

In some cases, a Class 2 CRISPR/Cas effector protein (of the subject compositions and/or methods) includes a first amino acid sequence having 75% or more sequence identity (e.g., 80% or more, 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY1, CasY2, CasY3, CasY4, CasY5, CasY6, CasY7, and CasY18 protein sequences depicted in FIG. 1; and a second amino acid sequence, C-terminal to the first amino acid sequence, that includes 3 partial RuvC domains—RuvC-I, RuvC-II, and RuvC-III—where: (i) the ratio of the length of the region between the RuvC-II and RuvC-III subdomains over the length of the RuvC-III subdomain is 1.1 or greater (e.g., 1.2); (ii) the ratio of the length of the region between the RuvC-II and RuvC-III subdomains over the length of the RuvC-III subdomain is greater than 1; (iii) the ratio of the length of the region between the RuvC-II and RuvC-III subdomains over the length of the RuvC-III subdomain is greater than land between 1 and 1.5 (e.g., 1 and 1.4, 1 and 1.3, 1 and 1.2); (iv) the ratio of the length of the RuvC-II subdomain over the length of the RuvC-III subdomain is 2 or less (e.g., 1.8 or less, 1.7 or less, 1.6 or less, 1.5 or less, or 1.4 or less); (v) the ratio of the length of the RuvC-II subdomain over the length of the RuvC-III subdomain is 1.5 or less (e.g., 1.4 or less); (vi) the ratio of the length of the RuvC-II subdomain over the length of the RuvC-III subdomain is in a range of from 1 to 2 (e.g., from 1.1 to 2, 1.2 to 2, 1 to 1.8, 1.1 to 1.8, 1.2 to 1.8, 1 to 1.6, 1.1 to 1.6, 1.2 to 1.6, 1 to 14, 1.1 to 1.4, or 1.2 to 1.4); (vii) the ratio of the length of the region between the RuvC-II and RuvC-III subdomains over the length of the RuvC-III subdomain is greater than 1; (viii) the ratio of the length of the region between the RuvC-II and RuvC-III subdomains over the length of the RuvC-III subdomain is greater than land between 1 and 1.5 (e.g., 1 and 1.2); (ix) the region between the RuvC-II and RuvC-III subdomains is at least 60 amino acids in length (e.g., at least 65 or at least 70 amino acids in length); (x) the region between the RuvC-II and RuvC-III subdomains is at least 65 amino acids in length; (xi) the region between the RuvC-II and RuvC-III subdomains has a length in a range of from 60-110 amino acids (e.g., a range of from 60-105, 60-100, 60-95, 60-90, 65-110, 65-105, 65-100, 65-95, or 65-90 amino acids); or (xii) the region between the RuvC-II and RuvC-III subdomains has a length in a range of from 65-95 amino acids.

In some cases, a Class 2 CRISPR/Cas effector protein (of the subject compositions and/or methods) includes a first amino acid sequence having 85% or more sequence identity (e.g., 90% or more, 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY1, CasY2, CasY3, CasY4, CasY5, CasY6, CasY7, and CasY18 protein sequences depicted in FIG. 1; and a second amino acid sequence, C-terminal to the first amino acid sequence, that includes 3 partial RuvC domains—RuvC-I, RuvC-II, and RuvC-III—where: (i) the ratio of the length of the region between the RuvC-II and RuvC-III subdomains over the length of the RuvC-III subdomain is 1.1 or greater (e.g., 1.2); (ii) the ratio of the length of the region between the RuvC-II and RuvC-III subdomains over the length of the RuvC-III subdomain is greater than 1; (iii) the ratio of the length of the region between the RuvC-II and RuvC-III subdomains over the length of the RuvC-III subdomain is greater than land between 1 and 1.5 (e.g., 1 and 1.4, 1 and 1.3, 1 and 1.2); (iv) the ratio of the length of the RuvC-II subdomain over the length of the RuvC-III subdomain is 2 or less (e.g., 1.8 or less, 1.7 or less, 1.6 or less, 1.5 or less, or 1.4 or less); (v) the ratio of the length of the RuvC-II subdomain over the length of the RuvC-III subdomain is 1.5 or less (e.g., 1.4 or less); (vi) the ratio of the length of the RuvC-II subdomain over the length of the RuvC-III subdomain is in a range of from 1 to 2 (e.g., from 1.1 to 2, 1.2 to 2, 1 to 1.8, 1.1 to 1.8, 1.2 to 1.8, 1 to 1.6, 1.1 to 1.6, 1.2 to 1.6, 1 to 14, 1.1 to 1.4, or 1.2 to 1.4); (vii) the ratio of the length of the region between the RuvC-II and RuvC-III subdomains over the length of the RuvC-III subdomain is greater than 1; (viii) the ratio of the length of the region between the RuvC-II and RuvC-III subdomains over the length of the RuvC-III subdomain is greater than land between 1 and 1.5 (e.g., 1 and 1.2); (ix) the region between the RuvC-II and RuvC-III subdomains is at least 60 amino acids in length (e.g., at least 65 or at least 70 amino acids in length); (x) the region between the RuvC-II and RuvC-III subdomains is at least 65 amino acids in length; (xi) the region between the RuvC-II and RuvC-III subdomains has a length in a range of from 60-110 amino acids (e.g., a range of from 60-105, 60-100, 60-95, 60-90, 65-110, 65-105, 65-100, 65-95, or 65-90 amino acids); or (xii) the region between the RuvC-II and RuvC-III subdomains has a length in a range of from 65-95 amino acids.

In some cases, a Class 2 CRISPR/Cas effector protein (of the subject compositions and/or methods) includes a first amino acid sequence having 50% or more sequence identity (e.g., 60% or more, 70% or more, 80% or more, 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY1, CasY2, CasY3, CasY4, CasY5, CasY6, CasY7, and CasY18 protein sequences depicted in FIG. 1; and a second amino acid sequence, C-terminal to the first amino acid sequence, that includes 3 partial RuvC domains—RuvC-I, RuvC-II, and RuvC-III—where: (i) the ratio of the length of the region between the RuvC-II and RuvC-III subdomains over the length of the RuvC-III subdomain is 1.1 or greater (e.g., 1.2); (ii) the ratio of the length of the region between the RuvC-II and RuvC-III subdomains over the length of the RuvC-III subdomain is greater than 1; (iii) the ratio of the length of the region between the RuvC-II and RuvC-III subdomains over the length of the RuvC-III subdomain is greater than land between 1 and 1.5 (e.g., 1 and 1.4, 1 and 1.3, 1 and 1.2); (iv) the ratio of the length of the RuvC-II subdomain over the length of the RuvC-III subdomain is 2 or less (e.g., 1.8 or less, 1.7 or less, 1.6 or less, 1.5 or less, or 1.4 or less); (v) the ratio of the length of the RuvC-II subdomain over the length of the RuvC-III subdomain is 1.5 or less (e.g., 1.4 or less); (vi) the ratio of the length of the RuvC-II subdomain over the length of the RuvC-III subdomain is in a range of from 1 to 2 (e.g., from 1.1 to 2, 1.2 to 2, 1 to 1.8, 1.1 to 1.8, 1.2 to 1.8, 1 to 1.6, 1.1 to 1.6, 1.2 to 1.6, 1 to 14, 1.1 to 1.4, or 1.2 to 1.4); (vii) the ratio of the length of the region between the RuvC-II and RuvC-III subdomains over the length of the RuvC-III subdomain is greater than 1; (viii) the ratio of the length of the region between the RuvC-II and RuvC-III subdomains over the length of the RuvC-III subdomain is greater than land between 1 and 1.5 (e.g., 1 and 1.2); (ix) the region between the RuvC-II and RuvC-III subdomains is at least 60 amino acids in length (e.g., at least 65 or at least 70 amino acids in length); (x) the region between the RuvC-II and RuvC-III subdomains is at least 65 amino acids in length; (xi) the region between the RuvC-II and RuvC-III subdomains has a length in a range of from 60-110 amino acids (e.g., a range of from 60-105, 60-100, 60-95, 60-90, 65-110, 65-105, 65-100, 65-95, or 65-90 amino acids); or (xii) the region between the RuvC-II and RuvC-III subdomains has a length in a range of from 65-95 amino acids.

In some cases, a Class 2 CRISPR/Cas effector protein (of the subject compositions and/or methods) includes a first amino acid sequence having 75% or more sequence identity (e.g., 80% or more, 85% or more, 90% or more, 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY1, CasY2, CasY3, CasY4, CasY5, CasY6, CasY7, and CasY18 protein sequences depicted in FIG. 1; and a second amino acid sequence, C-terminal to the first amino acid sequence, that includes 3 partial RuvC domains—RuvC-I, RuvC-II, and RuvC-III—where: (i) the ratio of the length of the region between the RuvC-II and RuvC-III subdomains over the length of the RuvC-III subdomain is 1.1 or greater (e.g., 1.2); (ii) the ratio of the length of the region between the RuvC-II and RuvC-III subdomains over the length of the RuvC-III subdomain is greater than 1; (iii) the ratio of the length of the region between the RuvC-II and RuvC-III subdomains over the length of the RuvC-III subdomain is greater than land between 1 and 1.5 (e.g., 1 and 1.4, 1 and 1.3, 1 and 1.2); (iv) the ratio of the length of the RuvC-II subdomain over the length of the RuvC-III subdomain is 2 or less (e.g., 1.8 or less, 1.7 or less, 1.6 or less, 1.5 or less, or 1.4 or less); (v) the ratio of the length of the RuvC-II subdomain over the length of the RuvC-III subdomain is 1.5 or less (e.g., 1.4 or less); (vi) the ratio of the length of the RuvC-II subdomain over the length of the RuvC-III subdomain is in a range of from 1 to 2 (e.g., from 1.1 to 2, 1.2 to 2, 1 to 1.8, 1.1 to 1.8, 1.2 to 1.8, 1 to 1.6, 1.1 to 1.6, 1.2 to 1.6, 1 to 14, 1.1 to 1.4, or 1.2 to 1.4); (vii) the ratio of the length of the region between the RuvC-II and RuvC-III subdomains over the length of the RuvC-III subdomain is greater than 1; (viii) the ratio of the length of the region between the RuvC-II and RuvC-III subdomains over the length of the RuvC-III subdomain is greater than land between 1 and 1.5 (e.g., 1 and 1.2); (ix) the region between the RuvC-II and RuvC-III subdomains is at least 60 amino acids in length (e.g., at least 65 or at least 70 amino acids in length); (x) the region between the RuvC-II and RuvC-III subdomains is at least 65 amino acids in length; (xi) the region between the RuvC-II and RuvC-III subdomains has a length in a range of from 60-110 amino acids (e.g., a range of from 60-105, 60-100, 60-95, 60-90, 65-110, 65-105, 65-100, 65-95, or 65-90 amino acids); or (xii) the region between the RuvC-II and RuvC-III subdomains has a length in a range of from 65-95 amino acids.

In some cases, a Class 2 CRISPR/Cas effector protein (of the subject compositions and/or methods) includes a first amino acid sequence having 85% or more sequence identity (e.g., 90% or more, 95% or more, 97% or more, 98% or more, 99% or more, or 100% sequence identity) with the N-terminal domain (e.g., the domain depicted as amino acids 1-812 for CasY1 in FIG. 9, panel a) of any one of the CasY1, CasY2, CasY3, CasY4, CasY5, CasY6, CasY7, and CasY18 protein sequences depicted in FIG. 1; and a second amino acid sequence, C-terminal to the first amino acid sequence, that includes 3 partial RuvC domains—RuvC-1, RuvC-11, and RuvC-111—where: (i) the ratio of the length of the region between the RuvC-II and RuvC-III subdomains over the length of the RuvC-III subdomain is 1.1 or greater (e.g., 1.2); (ii) the ratio of the length of the region between the RuvC-II and RuvC-III subdomains over the length of the RuvC-III subdomain is greater than 1; (iii) the ratio of the length of the region between the RuvC-II and RuvC-III subdomains over the length of the RuvC-III subdomain is greater than 1and between 1 and 1.5 (e.g., 1 and 1.4, 1 and 1.3, 1 and 1.2); (iv) the ratio of the length of the RuvC-TT subdomain over the length of the RuvC-III subdomain is 2 or less (e.g., 1.8 or less, 1.7 or less, 1.6 or less, 1.5 or less, or 1.4 or less); (v) the ratio of the length of the RuvC-II subdomain over the length of the RuvC-III subdomain is 1.5 or less (e.g., 1.4 or less); (vi) the ratio of the length of the RuvC-II subdomain over the length of the RuvC-III subdomain is in a range of from 1 to 2 (e.g., from 1.1 to 2, 1.2 to 2, 1 to 1.8, 1.1 to 1.8, 1.2 to 1.8, 1 to 1.6, 1.1 to 1.6, 1.2 to 1.6, 1 to 14, 1.1 to 1.4, or 1.2 to 1.4); (vii) the ratio of the length of the region between the RuvC-II and RuvC-III subdomains over the length of the RuvC-III subdomain is greater than 1; (viii) the ratio of the length of the region between the RuvC-II and RuvC-III subdomains over the length of the RuvC-III subdomain is greater than 1and between 1 and 1.5 (e.g., 1 and 1.2); (ix) the region between the RuvC-II and RuvC-III subdomains is at least 60 amino acids in length (e.g., at least 65 or at least 70 amino acids in length); (x) the region between the RuvC-II and RuvC-III subdomains is at least 65 amino acids in length; (xi) the region between the RuvC-II and RuvC-III subdomains has a length in a range of from 60-110 amino acids (e.g., a range of from 60-105, 60-100, 60-95, 60-90, 65-110, 65-105, 65-100, 65-95, or 65-90 amino acids); or (xii) the region between the RuvC-II and RuvC-III subdomains has a length in a range of from 65-95 amino acids.

In some cases, a Class 2 CRISPR/Cas effector protein (of the subject compositions and/or methods) includes a first amino acid sequence with an N-terminal domain (e.g., not including any fused heterologous sequence such as an NLS and/or a domain with a catalytic activity) having a length in a range of from 750 to 1050 amino acids (e.g, from 750 to 1025, 750 to 1000, 750 to 950, 775 to 1050, 775 to 1025, 775 to 1000, 775 to 950, 800 to 1050, 800 to 1025, 800 to 1000, or 800 to 950 amino acids); and a second amino acid sequence (C-terminal to the first) having a split Ruv C domain with 3 partial RuvC domains—RuvC-I, RuvC-II, and RuvC-III, where: (i) the ratio of the length of the region between the RuvC-II and RuvC-III subdomains over the length of the RuvC-III subdomain is 1.1 or greater (e.g., 1.2); (ii) the ratio of the length of the region between the RuvC-II and RuvC-III subdomains over the length of the RuvC-III subdomain is greater than 1; (iii) the ratio of the length of the region between the RuvC-II and RuvC-III subdomains over the length of the RuvC-III subdomain is greater than 1and between 1 and 1.5 (e.g., 1 and 1.4, 1 and 1.3, 1 and 1.2); (iv) the ratio of the length of the RuvC-II subdomain over the length of the RuvC-III subdomain is 2 or less (e.g., 1.8 or less, 1.7 or less, 1.6 or less, 1.5 or less, or 1.4 or less); (v) the ratio of the length of the RuvC-II subdomain over the length of the RuvC-III subdomain is 1.5 or less (e.g., 1.4 or less); (vi) the ratio of the length of the RuvC-II subdomain over the length of the RuvC-III subdomain is in a range of from 1 to 2 (e.g., from 1.1 to 2, 1.2 to 2, 1 to 1.8, 1.1 to 1.8, 1.2 to 1.8, 1 to 1.6, 1.1 to 1.6, 1.2 to 1.6, 1 to 14, 1.1 to 1.4, or 1.2 to 1.4); (vii) the ratio of the length of the region between the RuvC-II and RuvC-III subdomains over the length of the RuvC-III subdomain is greater than 1; (viii) the ratio of the length of the region between the RuvC-II and RuvC-III subdomains over the length of the RuvC-III subdomain is greater than 1and between 1 and 1.5 (e.g., 1 and 1.2); (ix) the region between the RuvC-II and RuvC-III subdomains is at least 60 amino acids in length (e.g., at least 65 or at least 70 amino acids in length); (x) the region between the RuvC-II and RuvC-III subdomains is at least 65 amino acids in length; (xi) the region between the RuvC-II and RuvC-III subdomains has a length in a range of from 60-110 amino acids (e.g., a range of from 60-105, 60-100, 60-95, 60-90, 65-110, 65-105, 65-100, 65-95, or 65-90 amino acids); or (xii) the region between the RuvC-II and RuvC-III subdomains has a length in a range of from 65-95 amino acids.

In some cases, a Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of the CasY1 protein sequence set forth in FIG. 1. For example, in some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of the CasY1 protein sequence set forth in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of the CasY1 protein sequence set forth in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the C-terminal domain (e.g., the domain depicted as amino acids 812-1125 for CasY1 in FIG. 9, panel a) of the CasY1 protein sequence set forth in FIG. 1. In some cases, a Class 2 CRISPR/Cas effector protein includes an amino acid sequence having amino acids 812-1125 of the CasY1 protein sequence set forth in FIG. 1.

In some cases, a Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, and CasY4 protein sequences set forth in FIG. 1. For example, in some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, and CasY4 protein sequences set forth in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, and CasY4 protein sequences set forth in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, and CasY4 protein sequences set forth in FIG. 1. In some cases, a Class 2 CRISPR/Cas effector protein includes a fragment of the amino acid sequence of any one of the CasY1, CasY2, CasY3, and CasY4 protein sequences set forth in FIG. 1 that corresponds to amino acids 812-1125 of the CasY1 protein sequence set forth in FIG. 1.

In some cases, a Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, CasY4, and CasY7 protein sequences set forth in FIG. 1. For example, in some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, CasY4, and CasY7 protein sequences set forth in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, CasY4, and CasY7 protein sequences set forth in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, CasY4, and CasY7 protein sequences set forth in FIG. 1. In some cases, a Class 2 CRISPR/Cas effector protein includes a fragment of the amino acid sequence of any one of the CasY1, CasY2, CasY3, CasY4, and CasY7 protein sequences set forth in FIG. 1 that corresponds to amino acids 812-1125 of the CasY1 protein sequence set forth in FIG. 1.

In some cases, a Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, CasY4, CasY5, CasY6, CasY7, and CasY18 protein sequences depicted in FIG. 1. For example, in some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, CasY4, CasY5, CasY6, CasY7, and CasY18 protein sequences depicted in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, CasY4, CasY5, CasY6, CasY7, and CasY18 protein sequences depicted in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, CasY4, CasY5, CasY6, CasY7, and CasY18 protein sequences depicted in FIG. 1. In some cases, a Class 2 CRISPR/Cas effector protein includes a fragment of the amino acid sequence of any one of the CasY1, CasY2, CasY3, CasY4, CasY5, CasY6, CasY7, and CasY18 protein sequences depicted in FIG. 1 that corresponds to amino acids 812-1125 of the CasY1 protein sequence set forth in FIG. 1.

In some cases, a Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, CasY4, CasY5, CasY6, CasY7, and CasY18 protein sequences depicted in FIG. 1. For example, in some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, CasY4, CasY5, CasY6, CasY7, and CasY18 protein sequences depicted in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, CasY4, CasY5, CasY6, CasY7, and CasY18 protein sequences depicted in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, CasY4, CasY5, CasY6, CasY7, and CasY18 protein sequences depicted in FIG. 1. In some cases, a Class 2 CRISPR/Cas effector protein includes a fragment of the amino acid sequence of any one of the CasY1, CasY2, CasY3, CasY4, CasY5, CasY6, CasY7, and CasY18 protein sequences depicted in FIG. 1 that corresponds to amino acids 812-1125 of the CasY1 protein sequence set forth in FIG. 1.

In some cases, a Class 2 CRISPR/Cas effector protein (of the subject compositions and/or methods) includes a first amino acid sequence (an N-terminal domain) (e.g., not including any fused heterologous sequence such as an NLS and/or a domain with a catalytic activity) having a length in a range of from 750 to 1050 amino acids (e.g, from 750 to 1025, 750 to 1000, 750 to 950, 775 to 1050, 775 to 1025, 775 to 1000, 775 to 950, 800 to 1050, 800 to 1025, 800 to 1000, or 800 to 950 amino acids); and a second amino acid sequence, positioned C-terminal to the first amino acid sequence, having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, and CasY4 protein sequences set forth in FIG. 1. For example, in some cases, a Class 2 CRISPR/Cas effector protein includes a first amino acid sequence (an N-terminal domain) (e.g., not including any fused heterologous sequence such as an NLS and/or a domain with a catalytic activity) having a length in a range of from 750 to 1050 amino acids (e.g, from 750 to 1025, 750 to 1000, 750 to 950, 775 to 1050, 775 to 1025, 775 to 1000, 775 to 950, 800 to 1050, 800 to 1025, 800 to 1000, or 800 to 950 amino acids); and a second amino acid sequence, positioned C-terminal to the first amino acid sequence, having 50% or more sequence identity (e.g., 60% or more, 70% or more, 80% or more, 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, and CasY4 protein sequences set forth in FIG. 1. In some cases, a Class 2 CRISPR/Cas effector protein includes a first amino acid sequence (an N-terminal domain) (e.g., not including any fused heterologous sequence such as an NLS and/or a domain with a catalytic activity) having a length in a range of from 750 to 1050 amino acids (e.g, from 750 to 1025, 750 to 1000, 750 to 950, 775 to 1050, 775 to 1025, 775 to 1000, 775 to 950, 800 to 1050, 800 to 1025, 800 to 1000, or 800 to 950 amino acids); and a second amino acid sequence, positioned C-terminal to the first amino acid sequence, having 80% or more sequence identity (e.g., 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, and CasY4 protein sequences set forth in FIG. 1. In some cases, a Class 2 CRISPR/Cas effector protein includes a first amino acid sequence (an N-terminal domain) (e.g., not including any fused heterologous sequence such as an NLS and/or a domain with a catalytic activity) having a length in a range of from 750 to 1050 amino acids (e.g, from 750 to 1025, 750 to 1000, 750 to 950, 775 to 1050, 775 to 1025, 775 to 1000, 775 to 950, 800 to 1050, 800 to 1025, 800 to 1000, or 800 to 950 amino acids); and a second amino acid sequence, positioned C-terminal to the first amino acid sequence, having 90% or more sequence identity (e.g., 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, and CasY4 protein sequences set forth in FIG. 1. In some cases, a Class 2 CRISPR/Cas effector protein includes a first amino acid sequence (an N-terminal domain) (e.g., not including any fused heterologous sequence such as an NLS and/or a domain with a catalytic activity) having a length in a range of from 750 to 1050 amino acids (e.g, from 750 to 1025, 750 to 1000, 750 to 950, 775 to 1050, 775 to 1025, 775 to 1000, 775 to 950, 800 to 1050, 800 to 1025, 800 to 1000, or 800 to 950 amino acids); and a second amino acid sequence, positioned C-terminal to the first amino acid sequence, having a fragment of the amino acid sequence of any one of the CasY1, CasY2, CasY3, and CasY4 protein sequences set forth in FIG. 1 that corresponds to amino acids 812-1125 of the CasY1 protein sequence set forth in FIG. 1.

In some cases, a Class 2 CRISPR/Cas effector protein (of the subject compositions and/or methods) includes a first amino acid sequence (an N-terminal domain) (e.g., not including any fused heterologous sequence such as an NLS and/or a domain with a catalytic activity) having a length in a range of from 750 to 1050 amino acids (e.g, from 750 to 1025, 750 to 1000, 750 to 950, 775 to 1050, 775 to 1025, 775 to 1000, 775 to 950, 800 to 1050, 800 to 1025, 800 to 1000, or 800 to 950 amino acids); and a second amino acid sequence, positioned C-terminal to the first amino acid sequence, having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, CasY4, and CasY7 protein sequences set forth in FIG. 1. For example, in some cases, a Class 2 CRISPR/Cas effector protein includes a first amino acid sequence (an N-terminal domain) (e.g., not including any fused heterologous sequence such as an NLS and/or a domain with a catalytic activity) having a length in a range of from 750 to 1050 amino acids (e.g, from 750 to 1025, 750 to 1000, 750 to 950, 775 to 1050, 775 to 1025, 775 to 1000, 775 to 950, 800 to 1050, 800 to 1025, 800 to 1000, or 800 to 950 amino acids); and a second amino acid sequence, positioned C-terminal to the first amino acid sequence, having 50% or more sequence identity (e.g., 60% or more, 70% or more, 80% or more, 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, CasY4, and CasY7 protein sequences set forth in FIG. 1. In some cases, a Class 2 CRISPR/Cas effector protein includes a first amino acid sequence (an N-terminal domain) (e.g., not including any fused heterologous sequence such as an NLS and/or a domain with a catalytic activity) having a length in a range of from 750 to 1050 amino acids (e.g, from 750 to 1025, 750 to 1000, 750 to 950, 775 to 1050, 775 to 1025, 775 to 1000, 775 to 950, 800 to 1050, 800 to 1025, 800 to 1000, or 800 to 950 amino acids); and a second amino acid sequence, positioned C-terminal to the first amino acid sequence, having 80% or more sequence identity (e.g., 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, CasY4, and CasY7 protein sequences set forth in FIG. 1. In some cases, a Class 2 CRISPR/Cas effector protein includes a first amino acid sequence (an N-terminal domain) (e.g., not including any fused heterologous sequence such as an NLS and/or a domain with a catalytic activity) having a length in a range of from 750 to 1050 amino acids (e.g, from 750 to 1025, 750 to 1000, 750 to 950, 775 to 1050, 775 to 1025, 775 to 1000, 775 to 950, 800 to 1050, 800 to 1025, 800 to 1000, or 800 to 950 amino acids); and a second amino acid sequence, positioned C-terminal to the first amino acid sequence, having 90% or more sequence identity (e.g., 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, CasY4, and CasY7 protein sequences set forth in FIG. 1. In some cases, a Class 2 CRISPR/Cas effector protein includes a first amino acid sequence (an N-terminal domain) (e.g., not including any fused heterologous sequence such as an NLS and/or a domain with a catalytic activity) having a length in a range of from 750 to 1050 amino acids (e.g, from 750 to 1025, 750 to 1000, 750 to 950, 775 to 1050, 775 to 1025, 775 to 1000, 775 to 950, 800 to 1050, 800 to 1025, 800 to 1000, or 800 to 950 amino acids); and a second amino acid sequence, positioned C-terminal to the first amino acid sequence, having a fragment of the amino acid sequence of any one of the CasY1, CasY2, CasY3, CasY4, and CasY7 protein sequences set forth in FIG. 1 that corresponds to amino acids 812-1125 of the CasY1 protein sequence set forth in FIG. 1.

In some cases, a Class 2 CRISPR/Cas effector protein (of the subject compositions and/or methods) includes a first amino acid sequence (an N-terminal domain) (e.g., not including any fused heterologous sequence such as an NLS and/or a domain with a catalytic activity) having a length in a range of from 750 to 1050 amino acids (e.g, from 750 to 1025, 750 to 1000, 750 to 950, 775 to 1050, 775 to 1025, 775 to 1000, 775 to 950, 800 to 1050, 800 to 1025, 800 to 1000, or 800 to 950 amino acids); and a second amino acid sequence, positioned C-terminal to the first amino acid sequence, having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, CasY4, CasY5, CasY6, CasY7, and CasY18 protein sequences depicted in FIG. 1. For example, in some cases, a Class 2 CRISPR/Cas effector protein includes a first amino acid sequence (an N-terminal domain) (e.g., not including any fused heterologous sequence such as an NLS and/or a domain with a catalytic activity) having a length in a range of from 750 to 1050 amino acids (e.g, from 750 to 1025, 750 to 1000, 750 to 950, 775 to 1050, 775 to 1025, 775 to 1000, 775 to 950, 800 to 1050, 800 to 1025, 800 to 1000, or 800 to 950 amino acids); and a second amino acid sequence, positioned C-terminal to the first amino acid sequence, having 50% or more sequence identity (e.g., 60% or more, 70% or more, 80% or more, 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, CasY4, CasY5, CasY6, CasY7, and CasY18 protein sequences depicted in FIG. 1. In some cases, a Class 2 CRISPR/Cas effector protein includes a first amino acid sequence (an N-terminal domain) (e.g., not including any fused heterologous sequence such as an NLS and/or a domain with a catalytic activity) having a length in a range of from 750 to 1050 amino acids (e.g, from 750 to 1025, 750 to 1000, 750 to 950, 775 to 1050, 775 to 1025, 775 to 1000, 775 to 950, 800 to 1050, 800 to 1025, 800 to 1000, or 800 to 950 amino acids); and a second amino acid sequence, positioned C-terminal to the first amino acid sequence, having 80% or more sequence identity (e.g., 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, CasY4, CasY5, CasY6, CasY7, and CasY18 protein sequences depicted in FIG. 1. In some cases, a Class 2 CRISPR/Cas effector protein includes a first amino acid sequence (an N-terminal domain) (e.g., not including any fused heterologous sequence such as an NLS and/or a domain with a catalytic activity) having a length in a range of from 750 to 1050 amino acids (e.g, from 750 to 1025, 750 to 1000, 750 to 950, 775 to 1050, 775 to 1025, 775 to 1000, 775 to 950, 800 to 1050, 800 to 1025, 800 to 1000, or 800 to 950 amino acids); and a second amino acid sequence, positioned C-terminal to the first amino acid sequence, having 90% or more sequence identity (e.g., 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, CasY4, CasY5, CasY6, CasY7, and CasY18 protein sequences depicted in FIG. 1. In some cases, a Class 2 CRISPR/Cas effector protein includes a first amino acid sequence (an N-terminal domain) (e.g., not including any fused heterologous sequence such as an NLS and/or a domain with a catalytic activity) having a length in a range of from 750 to 1050 amino acids (e.g, from 750 to 1025, 750 to 1000, 750 to 950, 775 to 1050, 775 to 1025, 775 to 1000, 775 to 950, 800 to 1050, 800 to 1025, 800 to 1000, or 800 to 950 amino acids); and a second amino acid sequence, positioned C-terminal to the first amino acid sequence, having a fragment of the amino acid sequence of any one of the CasY1, CasY2, CasY3, CasY4, CasY5, CasY6, CasY7, and CasY18 protein sequences depicted in FIG. 1 that corresponds to amino acids 812-1125 of the CasY1 protein sequence set forth in FIG. 1.

In some cases, a Class 2 CRISPR/Cas effector protein (of the subject compositions and/or methods) includes a first amino acid sequence (an N-terminal domain) (e.g., not including any fused heterologous sequence such as an NLS and/or a domain with a catalytic activity) having a length in a range of from 750 to 1050 amino acids (e.g, from 750 to 1025, 750 to 1000, 750 to 950, 775 to 1050, 775 to 1025, 775 to 1000, 775 to 950, 800 to 1050, 800 to 1025, 800 to 1000, or 800 to 950 amino acids); and a second amino acid sequence, positioned C-terminal to the first amino acid sequence, having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, CasY4, CasY5, CasY6, CasY7, and CasY18 protein sequences depicted in FIG. 1. For example, in some cases, a Class 2

CRISPR/Cas effector protein includes a first amino acid sequence (an N-terminal domain) (e.g., not including any fused heterologous sequence such as an NLS and/or a domain with a catalytic activity) having a length in a range of from 750 to 1050 amino acids (e.g, from 750 to 1025, 750 to 1000, 750 to 950, 775 to 1050, 775 to 1025, 775 to 1000, 775 to 950, 800 to 1050, 800 to 1025, 800 to 1000, or 800 to 950 amino acids); and a second amino acid sequence, positioned C-terminal to the first amino acid sequence, having 50% or more sequence identity (e.g., 60% or more, 70% or more, 80% or more, 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, CasY4, CasY5, CasY6, CasY7, and CasY18 protein sequences depicted in FIG. 1. In some cases, a Class 2 CRISPR/Cas effector protein includes a first amino acid sequence (an N-terminal domain) (e.g., not including any fused heterologous sequence such as an NLS and/or a domain with a catalytic activity) having a length in a range of from 750 to 1050 amino acids (e.g, from 750 to 1025, 750 to 1000, 750 to 950, 775 to 1050, 775 to 1025, 775 to 1000, 775 to 950, 800 to 1050, 800 to 1025, 800 to 1000, or 800 to 950 amino acids); and a second amino acid sequence, positioned C-terminal to the first amino acid sequence, having 80% or more sequence identity (e.g., 85% or more, 90% or more, 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, CasY4, CasY5, CasY6, CasY7, and CasY18 protein sequences depicted in FIG. 1. In some cases, a Class 2 CRISPR/Cas effector protein includes a first amino acid sequence (an N-terminal domain) (e.g., not including any fused heterologous sequence such as an NLS and/or a domain with a catalytic activity) having a length in a range of from 750 to 1050 amino acids (e.g, from 750 to 1025, 750 to 1000, 750 to 950, 775 to 1050, 775 to 1025, 775 to 1000, 775 to 950, 800 to 1050, 800 to 1025, 800 to 1000, or 800 to 950 amino acids); and a second amino acid sequence, positioned C-terminal to the first amino acid sequence, having 90% or more sequence identity (e.g., 95% or more, 97% or more, 98% or more, 99% or more, or 100% sequence identity) with the C-terminal domain (e.g., the domain depicted as amino acids 812-1125 for CasY1 in FIG. 9, panel a) of any one of the CasY1, CasY2, CasY3, CasY4, CasY5, CasY6, CasY7, and CasY18 protein sequences depicted in FIG. 1. In some cases, a Class 2 CRISPR/Cas effector protein includes a first amino acid sequence (an N-terminal domain) (e.g., not including any fused heterologous sequence such as an NLS and/or a domain with a catalytic activity) having a length in a range of from 750 to 1050 amino acids (e.g, from 750 to 1025, 750 to 1000, 750 to 950, 775 to 1050, 775 to 1025, 775 to 1000, 775 to 950, 800 to 1050, 800 to 1025, 800 to 1000, or 800 to 950 amino acids); and a second amino acid sequence, positioned C-terminal to the first amino acid sequence, having a fragment of the amino acid sequence of any one of the CasY1, CasY2, CasY3, CasY4, CasY5, CasY6, CasY7, and CasY18 protein sequences depicted in FIG. 1 that corresponds to amino acids 812-1125 of the CasY1 protein sequence set forth in FIG. 1.

In some cases, a Class 2 CRISPR/Cas effector protein includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with the CasY9, CasY10, CasY11, CasY12, CasY13, CasY14, CasY15, or CasY16 protein sequences set forth in FIG. 1. In some cases, a Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with the CasY9, CasY10, CasY11, CasY12, CasY13, CasY14, CasY15, or CasY16 protein sequences set forth in FIG. 1. In some cases, a Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with the CasY9, CasY10, CasY11, CasY12, CasY13, CasY14, CasY15, or CasY16 protein sequences set forth in FIG. 1. In some cases, a Class 2 CRISPR/Cas effector protein includes an amino acid sequence having 90% or more sequence identity (e.g., 95% or more, 97% or more, 98% or more, 99% or more, or 100% sequence identity) with the CasY9, CasY10, CasY11, CasY12, CasY13, CasY14, CasY15, or CasY16 protein sequences set forth in FIG. 1. In some cases, a Class 2 CRISPR/Cas effector protein includes an amino acid sequence having the CasY9, CasY10, CasY11, CasY12, CasY13, CasY14, CasY15, or CasY16 protein sequence set forth in FIG. 1. In some cases, a Class 2 CRISPR/Cas effector protein includes an amino acid sequence having the CasY9, CasY10, CasY11, CasY12, CasY13, CasY14, CasY15, or CasY16 protein sequence set forth in FIG. 1, with the exception that the sequence includes an amino acid substitution (e.g., 1, 2, or 3 amino acid substitutions) that reduces the naturally occurring catalytic activity of the protein (e.g., such as at amino acid positions described below).

iii. CasZ Proteins

Another example of a naturally existing Class 2 CRISPR/Cas effector protein is CasZ. A CasZ polypeptide (this term is used interchangeably with the term "CasZ protein", "Cas14, "Cas14 polypeptide, or "Cas14 protein") can bind and/or modify (e.g., cleave, nick, methylate, demethylate, etc.) a target nucleic acid and/or a polypeptide associated with target nucleic acid (e.g., methylation or acetylation of a histone tail) (e.g., in some cases the CasZ protein includes a fusion partner with an activity, and in some cases the CasZ protein provides nuclease activity). In some cases, the Class 2 CRISPR/Cas effector protein is a naturally-occurring protein (e.g., naturally occurs in prokaryotic cells) (e.g., a CasZ protein). In other cases, the Class 2 CRISPR/Cas effector protein is not a naturally-occurring polypeptide (e.g., the CasZ protein is a variant CasZ protein, a chimeric protein, and the like). A CasZ protein includes 3 partial RuvC domains (RuvC-I, RuvC-II, and RuvC-III, also referred to herein as subdomains) that are not contiguous with respect to the primary amino acid sequence of the CasZ protein, but form a RuvC domain once the protein is produced and folds. A naturally occurring CasZ protein functions as an endonuclease that catalyzes cleavage at a specific sequence in a targeted nucleic acid (e.g., a double stranded DNA (dsDNA)). The sequence specificity is provided by the associated guide RNA, which hybridizes to a target sequence within the target DNA. The naturally occurring CasZ guide RNA is a crRNA, where the crRNA includes (i) a guide sequence that hybridizes to a target sequence in the target DNA and (ii) a protein binding segment that binds to the CasZ protein.

In some embodiments, the Class 2 CRISPR/Cas effector protein of the subject methods and/or compositions is (or is derived from) a naturally occurring (wild type) CasZ protein. Examples of naturally occurring CasZ proteins (e.g., CasZa, CasZb, CasZc, CasZd, CasZe, CasZf, CasZg, CasZh, CasZi, CasZj, CasZk, CasZl) are depicted in FIG. 1 or FIG. 29. In some cases, a subject Class 2 CRTSPR/Cas effector protein is a CasZa protein. In some cases, a subject Class 2 CRISPR/Cas effector protein is a CasZb protein. In some cases, a subject Class 2 CRISPR/Cas effector protein is a CasZc protein. In some cases, a subject Class 2 CRISPR/Cas effector protein is a CasZd protein. In some cases, a subject Class 2 CRISPR/Cas effector protein is a CasZe protein. In some cases, a subject Class 2 CRISPR/Cas effector protein is a CasZf protein. In some cases, a subject Class 2 CRISPR/Cas effector protein is a CasZg protein. In some cases, a subject Class 2 CRISPR/Cas effector protein is a CasZh protein. In some cases, a subject Class 2 CRISPR/Cas effector protein is a CasZi protein. In some cases, a subject Class 2 CRISPR/Cas effector protein is a CasZj protein. In some cases, a subject Class 2 CRISPR/Cas effector protein is a CasZk protein. In some cases, a subject Class 2 CRISPR/Cas effector protein is a CasZl protein. In some cases, a subject Class 2 CRISPR/Cas effector protein is a CasZe, CasZf, CasZg, or CasZh protein. In some cases, a subject Class 2 CRISPR/Cas effector protein is a CasZj, CasZk, or CasZl protein.

It is important to note that CasZ is short compared to previously identified CRISPR-Cas endonucleases, and thus use of this protein as an alternative provides the advantage that the nucleotide sequence encoding the protein is relatively short. This is useful, for example, in cases where a nucleic acid encoding the CasZ protein is desirable, e.g., in situations that employ a viral vector (e.g., an AAV vector), for delivery to a cell such as a eukaryotic cell (e.g., mammalian cell, human cell, mouse cell, in vitro, ex vivo, in vivo) for research and/or clinical applications. In addition, in their natural context, the CasZ-encoding DNA sequences are present in loci that also have a Cas1 protein.

In some cases a subject Class 2 CRISPR/Cas effector protein has a length of 900 amino acids or less (e.g., 850 amino acids or less, 800 amino acids or less, 750 amino acids or less, or 700 amino acids or less). In some cases a subject Class 2 CRISPR/Cas effector protein has a length of 850 amino acids or less (e.g., 850 amino acids or less). In some cases a subject Class 2 CRISPR/Cas effector protein length of 800 amino acids or less (e.g., 750 amino acids or less). In some cases a subject Class 2 CRISPR/Cas effector protein has a length of 700 amino acids or less. In some cases a subject Class 2 CRISPR/Cas effector protein has a length of 650 amino acids or less.

In some cases a subject Class 2 CRISPR/Cas effector protein has a length in a range of from 350-900 amino acids (e.g., 350-850, 350-800, 350-750, 350-700, 400-900, 400-850, 400-800, 400-750, or 400-700 amino acids).

In some cases a subject Class 2 CRISPR/Cas effector protein (e.g., CasZa) has a length in a range of from 350-750 amino acids (e.g., 350-700, 350-550, 450-550, 450-750, 450-650, or 450-550 amino acids). In some cases a subject Class 2 CRISPR/Cas effector protein (e.g., CasZa) has a length in a range of from 450-750 amino acids (e.g., 500-700 amino acids). In some cases a subject Class 2 CRISPR/Cas effector protein (e.g., CasZa) has a length in a range of from 350-700 amino acids (e.g., 350-650, 350-600, or 350-550 amino acids). In some cases a subject Class 2 CRISPR/Cas effector protein (e.g., CasZa) has a length in a range of from 500-700 amino acids. In some cases a subject Class 2 CRISPR/Cas effector protein (e.g., CasZa) has a length in a range of from 450-550 amino acids. In some cases a subject Class 2 CRISPR/Cas effector protein (e.g., CasZa) has a length in a range of from 350-550 amino acids.

In some cases a subject Class 2 CRISPR/Cas effector protein (e.g., CasZb) has a length in a range of from 350-700 amino acids (e.g., 350-650, or 350-620 amino acids). In some cases a subject Class 2 CRISPR/Cas effector protein (e.g., CasZb) has a length in a range of from 450-700 amino acids (e.g., 450-650, 500-650 or 500-620 amino acids). In some cases a subject Class 2 CRISPR/Cas effector protein (e.g., CasZb) has a length in a range of from 500-650 amino acids (e.g., 500-620 amino acids). In some cases a subject Class 2 CRISPR/Cas effector protein (e.g., CasZb) has a length in a range of from 500-620 amino acids.

In some cases a subject Class 2 CRISPR/Cas effector protein (e.g., CasZc) has a length in a range of from 600-800 amino acids (e.g., 600-650 or 700-800 amino acids). In some cases a subject Class 2 CRISPR/Cas effector protein (e.g., CasZc) has a length in a range of from 600-650 amino acids. In some cases a subject Class 2 CRISPR/Cas effector protein (e.g., CasZc) has a length in a range of from 700-800 amino acids.

In some cases a subject Class 2 CRISPR/Cas effector protein (e.g., CasZd) has a length in a range of from 400-650 amino acids (e.g., 400-600, 400-550, 500-650, 500-600 or 500-550 amino acids). In some cases a subject Class 2 CRISPR/Cas effector protein (e.g., CasZd) has a length in a range of from 500-600 amino acids. In some cases a subject Class 2 CRISPR/Cas effector protein (e.g., CasZd) has a length in a range of from 500-550 amino acids. In some cases a subject Class 2 CRISPR/Cas effector protein (e.g., CasZd) has a length in a range of from 400-550 amino acids.

In some cases a subject Class 2 CRISPR/Cas effector protein (e.g., CasZe) has a length in a range of from 450-700 amino acids (e.g., 450-650, 450-615, 475-700, 475-650, or 475-615 amino acids). In some cases a subject Class 2 CRISPR/Cas effector protein (e.g., CasZe) has a length in a range of from 450-675 amino acids. In some cases a subject Class 2 CRISPR/Cas effector protein (e.g., CasZe) has a length in a range of from 475-675 amino acids.

In some cases a subject Class 2 CRISPR/Cas effector protein (e.g., CasZf) has a length in a range of from 400-550 amino acids (e.g., 400-520, 400-500, 400-475, 415-550, 415-520, 415-500, or 415-475 amino acids). In some cases a subject Class 2 CRISPR/Cas effector protein (e.g., CasZf) has a length in a range of from 400-475 amino acids (e.g., 400-450 amino acids).

In some cases a subject Class 2 CRISPR/Cas effector protein (e.g., CasZg) has a length in a range of from 500-750 amino acids (e.g., 550-750 or 500-700 amino acids). In some cases a subject Class 2 CRISPR/Cas effector protein (e.g., CasZg) has a length in a range of from 700-750 amino acids. In some cases a subject Class 2 CRISPR/Cas effector protein (e.g., CasZg) has a length in a range of from 550-600 amino acids.

In some cases a subject Class 2 CRISPR/Cas effector protein (e.g., CasZh) has a length in a range of from 380-450 amino acids (e.g., 380-420, 400-450, or 400-420 amino acids). In some cases a subject Class 2 CRISPR/Cas effector protein (e.g., CasZh) has a length in a range of from 400-420 amino acids.

In some cases a subject Class 2 CRISPR/Cas effector protein (e.g., CasZi) has a length in a range of from 700-800 amino acids (e.g., 700-750, 720-800, or 720-750 amino acids). In some cases a subject Class 2 CRISPR/Cas effector protein (e.g., CasZi) has a length in a range of from 720-780 amino acids.

In some cases a subject Class 2 CRISPR/Cas effector protein (e.g., CasZj) has a length in a range of from 600-750 amino acids (e.g., 600-700 or 650-700 amino acids). In some cases a subject Class 2 CRISPR/Cas effector protein (e.g., CasZj) has a length in a range of from 400-420 amino acids.

In some cases a subject Class 2 CRISPR/Cas effector protein (e.g., CasZk) has a length in a range of from 450-600 amino acids (e.g., 450-580, 480-600, 480-580, or 500-600 amino acids). In some cases a subject Class 2 CRISPR/Cas effector protein (e.g., CasZk) has a length in a range of from 480-580 amino acids.

In some cases a subject Class 2 CRISPR/Cas effector protein (e.g., CasZl) has a length in a range of from 350-500 amino acids (e.g., 350-450, 380-450, 350-420, or 380-420 amino acids). In some cases a subject Class 2 CRISPR/Cas effector protein (e.g., CasZl) has a length in a range of from 380-420 amino acids.

In some cases, a subject Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with a CasZa protein of FIG. 1 or FIG. 29. For example, in some cases, a subject Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with a CasZa protein of FIG. 1 or FIG. 29. In some cases, a subject Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with a CasZa protein of FIG. 1 or FIG. 29. In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZa protein of FIG. 1 or FIG. 29. In some cases, a subject Class 2 CRISPR/Cas effector protein includes a CasZa amino acid sequence of FIG. 1 or FIG. 29. In some cases, a subject Class 2 CRISPR/Cas effector protein includes a CasZa amino acid sequence of FIG. 1 or FIG. 29, with the exception that the sequence includes an amino acid substitution (e.g., 1, 2, or 3 amino acid substitutions) that reduces the naturally occurring catalytic activity of the protein (e.g., such as at one or more catalytic amino acid positions)(e.g., in some cases such that the CasZ protein is a dCasZ). In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZa protein of FIG. 1 or FIG. 29 and has a length in a range of from 350-800 amino (e.g., 350-800, 350-750, 350-700, 350-550, 450-550, 450-750, 450-650, or 450-550 amino acids).

In some cases, a subject Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with a CasZb protein of FIG. 1 or FIG. 29. For example, in some cases, a subject Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with a CasZb protein of FIG. 1 or FIG. 29. In some cases, a subject Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with a CasZb protein of FIG. 1 or FIG. 29. In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZb protein of FIG. 1 or FIG. 29. In some cases, a subject Class 2 CRISPR/Cas effector protein includes a CasZb amino acid sequence of FIG. 1 or FIG. 29. In some cases, a subject Class 2 CRISPR/Cas effector protein includes a CasZb amino acid sequence of FIG. 1 or FIG. 29, with the exception that the sequence includes an amino acid substitution (e.g., 1, 2, or 3 amino acid substitutions) that reduces the naturally occurring catalytic activity of the protein (e.g., such as at one or more catalytic amino acid positions)(e.g., in some cases such that the CasZ protein is a dCasZ). In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZb protein of FIG. 1 or FIG. 29 and has a length in a range of from 350-700 amino acids (e.g., 350-650, or 350-620 amino acids).

In some cases, a subject Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with a CasZc protein of FIG. 1 or FIG. 29. For example, in some cases, a subject Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with a CasZc protein of FIG. 1 or FIG. 29. In some cases, a subject Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with a CasZc protein of FIG. 1 or FIG. 29. In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZc protein of FIG. 1 or FIG. 29. In some cases, a subject Class 2 CRISPR/Cas effector protein includes a CasZc amino acid sequence of FIG. 1 or FIG. 29. In some cases, a subject Class 2 CRISPR/Cas effector protein includes a CasZc amino acid sequence of FIG. 1 or FIG. 29, with the exception that the sequence includes an amino acid substitution (e.g., 1, 2, or 3 amino acid substitutions) that reduces the naturally occurring catalytic activity of the protein (e.g., such as at one or more catalytic amino acid positions)(e.g., in some cases such that the CasZ protein is a dCasZ). In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZc protein of FIG. 1 or FIG. 29 and has a length in a range of from 600-800 amino acids (e.g., 600-650 or 700-800 amino acids).

In some cases, a subject Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with a CasZd protein of FIG. 1 or FIG. 29. For example, in some cases, a subject Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with a CasZd protein of FIG. 1 or FIG. 29. In some cases, a subject Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with a CasZd protein of FIG. 1 or FIG. 29. In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZd protein of FIG. 1 or FIG. 29. In some cases, a subject Class 2 CRISPR/Cas effector protein includes a CasZd amino acid sequence of FIG. 1 or FIG. 29. In some cases, a subject Class 2 CRISPR/Cas effector protein includes a CasZd amino acid sequence of FIG. 1 or FIG. 29, with the exception that the sequence includes an amino acid substitution (e.g., 1, 2, or 3 amino acid substitutions) that reduces the naturally occurring catalytic activity of the protein (e.g., such as at one or more catalytic amino acid positions)(e.g., in some cases such that the CasZ protein is a dCasZ). In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZd protein of FIG. 1 or FIG. 29 and has a length in a range of from 400-650 amino acids (e.g., 400-600, 400-550, 500-650, 500-600 or 500-550 amino acids).

In some cases, a subject Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with a CasZe protein of FIG. 1 or FIG. 29. For example, in some cases, a subject Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with a CasZe protein of FIG. 1 or FIG. 29. In some cases, a subject Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with a CasZe protein of FIG. 1 or FIG. 29.

In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZe protein of FIG. 1 or FIG. 29. In some cases, a subject Class 2 CRISPR/Cas effector protein includes a CasZe amino acid sequence of FIG. 1 or FIG. 29. In some cases, a subject Class 2 CRISPR/Cas effector protein includes a CasZe amino acid sequence of FIG. 1 or FIG. 29, with the exception that the sequence includes an amino acid substitution (e.g., 1, 2, or 3 amino acid substitutions) that reduces the naturally occurring catalytic activity of the protein (e.g., such as at one or more catalytic amino acid positions)(e.g., in some cases such that the CasZ protein is a dCasZ). In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZe protein of FIG. 1 or FIG. 29 and has a length in a range of from 450-700 amino acids (e.g., 450-650, 450-615, 475-700, 475-650, or 475-615 amino acids).

In some cases, a subject Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with a CasZf protein of FIG. 1 or FIG. 29. For example, in some cases, a subject Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with a CasZf protein of FIG. 1 or FIG. 29. In some cases, a subject Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with a CasZf protein of FIG. 1 or FIG. 29. In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZf protein of FIG. 1 or FIG. 29. In some cases, a subject Class 2 CRISPR/Cas effector protein includes a CasZf amino acid sequence of FIG. 1 or FIG. 29. In some cases, a subject Class 2 CRISPR/Cas effector protein includes a CasZf amino acid sequence of FIG. 1 or FIG. 29, with the exception that the sequence includes an amino acid substitution (e.g., 1, 2, or 3 amino acid substitutions) that reduces the naturally occurring catalytic activity of the protein (e.g., such as at one or more catalytic amino acid positions)(e.g., in some cases such that the CasZ protein is a dCasZ). In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZf protein of FIG. 1 or FIG. 29 and has a length in a range of from 400-750 amino (e.g., 400-700, 700-650, 400-620, 400-600, 400-550, 400-520, 400-500, 400-475, 415-550, 415-520, 415-500, or 415-475 amino acids).

In some cases, a subject Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with a CasZg protein of FIG. 1 or FIG. 29. For example, in some cases, a subject Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with a CasZg protein of FIG. 1 or FIG. 29. In some cases, a subject Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with a CasZg protein of FIG. 1 or FIG. 29. In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZg protein of FIG. 1 or FIG. 29. In some cases, a subject Class 2 CRISPR/Cas effector protein includes a CasZg amino acid sequence of FIG. 1 or FIG. 29. In some cases, a subject Class 2 CRISPR/Cas effector protein includes a CasZg amino acid sequence of FIG. 1 or FIG. 29, with the exception that the sequence includes an amino acid substitution (e.g., 1, 2, or 3 amino acid substitutions) that reduces the naturally occurring catalytic activity of the protein (e.g., such as at one or more catalytic amino acid positions)(e.g., in some cases such that the CasZ protein is a dCasZ). In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZg protein of FIG. 1 or FIG. 29 and has a length in a range of from 500-750 amino acids (e.g., 500-750 amino acids (e.g., 550-750 amino acids)).

In some cases, a subject Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with a CasZh protein of FIG. 1 or FIG. 29. For example, in some cases, a subject Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with a CasZh protein of FIG. 1 or FIG. 29. In some cases, a subject Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with a CasZh protein of FIG. 1 or FIG. 29. In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZh protein of FIG. 1 or FIG. 29. In some cases, a subject Class 2 CRISPR/Cas effector protein includes a CasZh amino acid sequence of FIG. 1 or FIG. 29. In some cases, a subject Class 2 CRISPR/Cas effector protein includes a CasZh amino acid sequence of FIG. 1 or FIG. 29, with the exception that the sequence includes an amino acid substitution (e.g., 1, 2, or 3 amino acid substitutions) that reduces the naturally occurring catalytic activity of the protein (e.g., such as at one or more catalytic amino acid positions)(e.g., in some cases such that the CasZ protein is a dCasZ). In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZh protein of FIG. 1 or FIG. 29 and has a length in a range of from 380-450 amino acids (e.g., 380-420, 400-450, or 400-420 amino acids).

In some cases, a subject Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with a CasZi protein of FIG. 1 or FIG. 29. For example, in some cases, a subject Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with a CasZi protein of FIG. 1 or FIG. 29. In some cases, a subject Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with a CasZi protein of FIG. 1 or FIG. 29. In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZi protein of FIG. 1 or FIG. 29. In some cases, a subject Class 2 CRISPR/Cas effector protein includes a CasZi amino acid sequence of FIG. 1 or FIG. 29. In some cases, a subject Class 2 CRISPR/Cas effector protein includes a CasZi amino acid sequence of FIG. 1 or FIG. 29, with the exception that the sequence includes an amino acid substitution (e.g., 1, 2, or 3 amino acid substitutions) that reduces the naturally occurring catalytic activity of the protein (e.g., such as at one or more catalytic amino acid positions)(e.g., in some cases such that the CasZ protein is a dCasZ). In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZi protein of FIG. 1 or FIG. 29 and has a length in a range of from 700-800 amino acids (e.g., 700-750, 720-800, or 720-750 amino acids).

In some cases, a subject Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with a CasZj protein of FIG. 1 or FIG. 29. For example, in some cases, a subject Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with a CasZj protein of FIG. 1 or FIG. 29. In some cases, a subject Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with a CasZj protein of FIG. 1 or FIG. 29. In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZj protein of FIG. 1 or FIG. 29. In some cases, a subject Class 2 CRISPR/Cas effector protein includes a CasZj amino acid sequence of FIG. 1 or FIG. 29. In some cases, a subject Class 2 CRISPR/Cas effector protein includes a CasZj amino acid sequence of FIG. 1 or FIG. 29, with the exception that the sequence includes an amino acid substitution (e.g., 1, 2, or 3 amino acid substitutions) that reduces the naturally occurring catalytic activity of the protein (e.g., such as at one or more catalytic amino acid positions)(e.g., in some cases such that the CasZ protein is a dCasZ). In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZj protein of FIG. 1 or FIG. 29 and has a length in a range of from 600-750 amino acids (e.g., 600-700 or 650-700 amino acids).

In some cases, a subject Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with a CasZk protein of FIG. 1 or FIG. 29. For example, in some cases, a subject Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with a CasZk protein of FIG. 1 or FIG. 29. In some cases, a subject Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with a CasZk protein of FIG. 1 or FIG. 29. In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZk protein of FIG. 1 or FIG. 29. In some cases, a subject Class 2 CRISPR/Cas effector protein includes a CasZk amino acid sequence of FIG. 1 or FIG. 29. In some cases, a subject Class 2 CRISPR/Cas effector protein includes a CasZk amino acid sequence of FIG. 1 or FIG. 29, with the exception that the sequence includes an amino acid substitution (e.g., 1, 2, or 3 amino acid substitutions) that reduces the naturally occurring catalytic activity of the protein (e.g., such as at one or more catalytic amino acid positions)(e.g., in some cases such that the CasZ protein is a dCasZ). In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZk protein of FIG. 1 or FIG. 29 and has a length in a range of from 450-600 amino acids (e.g., 450-580, 480-600, 480-580, or 500-600 amino acids).

In some cases, a subject Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with a CasZl protein of FIG. 1 or FIG. 29. For example, in some cases, a subject Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with a CasZl protein of FIG. 1 or FIG. 29. In some cases, a subject Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with a CasZl protein of FIG. 1 or FIG. 29. In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZl protein of FIG. 1 or FIG. 29. In some cases, a subject Class 2 CRISPR/Cas effector protein includes a CasZl amino acid sequence of FIG. 1 or FIG. 29. In some cases, a subject Class 2 CRISPR/Cas effector protein includes a CasZl amino acid sequence of FIG. 1 or FIG. 29, with the exception that the sequence includes an amino acid substitution (e.g., 1, 2, or 3 amino acid substitutions) that reduces the naturally occurring catalytic activity of the protein (e.g., such as at one or more catalytic amino acid positions)(e.g., in some cases such that the CasZ protein is a dCasZ). In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZl protein of FIG. 1 or FIG. 29 and has a length in a range of from 450-600 amino acids (e.g., 450-580, 480-600, 480-580, or 500-600 amino acids).

In some cases, a subject Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with a CasZe, CasZf, CasZg, or CasZh protein of FIG. 1 or FIG. 29. For example, in some cases, a subject Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with a CasZe, CasZf, CasZg, or CasZh protein of FIG. 1 or FIG. 29. In some cases, a subject Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with a CasZe, CasZf, CasZg, or CasZh protein of FIG. 1 or FIG. 29. In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZe, CasZf, CasZg, or CasZh protein of FIG. 1 or FIG. 29. In some cases, a subject Class 2 CRISPR/Cas effector protein includes an amino acid sequence having a CasZe, CasZf, CasZg, or CasZh protein sequence of FIG. 1 or FIG. 29. In some cases, a subject Class 2 CRISPR/Cas effector protein includes an amino acid sequence having a CasZe, CasZf, CasZg, or CasZh protein sequence of FIG. 1 or FIG.

29, with the exception that the sequence includes an amino acid substitution (e.g., 1, 2, or 3 amino acid substitutions) that reduces the naturally occurring catalytic activity of the protein (e.g., such as at one or more catalytic amino acid positions). In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZe, CasZf, CasZg, or CasZh protein of FIG. 1 or FIG. 29 and has a length in a range of from 350-900 amino acids (e.g., 350-850, 350-800, 400-900, 400-850, or 400-800 amino acids).

In some cases, a subject Class 2 CRISPR/Cas effector protein (of the subject compositions and/or methods) includes an amino acid sequence having 20% or more sequence identity (e.g., 30% or more, 40% or more, 50% or more, 60% or more, 70% or more, 80% or more, 85% or more, 90% or more, 95% or more, 97% or more, 98% or more, 99% or more, or 100% sequence identity) with a CasZa, CasZb, CasZc, CasZd, CasZe, CasZf, CasZg, CasZh, CasZi, CasZj, CasZK, or CasZl protein of FIG. 1 or FIG. 29. For example, in some cases, a subject Class 2 CRISPR/Cas effector protein includes an amino acid sequence having 50% or more sequence identity (e.g., 60% or more, 70% or more, 80% or more, 85% or more, 90% or more, 95% or more, 97% or more, 98% or more, 99% or more, or 100% sequence identity) with a CasZa, CasZb, CasZc, CasZd, CasZe, CasZf, CasZg, CasZh, CasZi, CasZj, CasZK, or CasZl protein of FIG. 1 or FIG. 29. In some cases, a subject Class 2 CRISPR/Cas effector protein includes an amino acid sequence having 80% or more sequence identity (e.g., 85% or more, 90% or more, 95% or more, 97% or more, 98% or more, 99% or more, or 100% sequence identity) with a CasZa, CasZb, CasZc, CasZd, CasZe, CasZf, CasZg, CasZh, CasZi, CasZj, CasZK, or CasZl protein of FIG. 1 or FIG. 29. In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZa, CasZb, CasZc, CasZd, CasZe, CasZf, CasZg, CasZh, CasZi, CasZj, CasZK, or CasZl protein of FIG. 1 or FIG. 29. In some cases, a subject Class 2 CRISPR/Cas effector protein includes an amino acid sequence having a CasZa, CasZb, CasZc, CasZd, CasZe, CasZf, CasZg, CasZh, CasZi, CasZj, CasZK, or CasZl protein sequence of FIG. 1 or FIG. 29. In some cases, a subject Class 2 CRISPR/Cas effector protein includes an amino acid sequence having a CasZa, CasZb, CasZc, CasZd, CasZe, CasZf, CasZg, CasZh, CasZi, CasZj, CasZK, or CasZl protein sequence of FIG. 1 or FIG. 29, with the exception that the sequence includes an amino acid substitution (e.g., 1, 2, or 3 amino acid substitutions) that reduces the naturally occurring catalytic activity of the protein (e.g., such as at one or more catalytic amino acid positions). In some cases, a subject Class 2 CRISPR/Cas effector protein includes an amino acid sequence having 90% or more sequence identity (e.g., 95% or more, 97% or more, 98% or more, 99% or more, or 100% sequence identity) with a CasZa, CasZb, CasZc, CasZd, CasZe, CasZf, CasZg, CasZh, CasZi, CasZj, CasZK, or CasZl protein of FIG. 1 or FIG. 29 and has a length in a range of from 350-900 amino acids (e.g., 350-850, 350-800, 400-900, 400-850, or 400-800 amino acids).

Detection of ssDNA

A CasZ (Cas14) or a CasY polypeptide of the present disclosure, once activated by detection of a target DNA (double or single stranded), can promiscuously cleave non-targeted single stranded DNA (ssDNA). Once a CasZ (Cas14) polypeptide or a CasY polypeptide is activated by a guide RNA, which occurs when the guide RNA hybridizes to a target sequence of a target DNA (i.e., the sample includes the target DNA, e.g., target ssDNA), the protein becomes a nuclease that promiscuously cleaves ssDNAs (i.e., the nuclease cleaves non-target ssDNAs, i.e., ssDNAs to which the guide sequence of the guide RNA does not hybridize). Thus, when the target DNA is present in the sample (e.g., in some cases above a threshold amount), the result is cleavage of ssDNAs in the sample, which can be detected using any convenient detection method (e.g., using a labeled single stranded detector DNA). In some cases, a CasY polypeptide requires, in addition to a CasY guide RNA, a tranc RNA for activation. In some cases, a CasZ polypeptide requires, in addition to a CasY guide RNA, a tranc RNA for activation.

Provided are compositions and methods for detecting a target DNA (double stranded or single stranded) in a sample. In some cases, a detector DNA is used that is single stranded (ssDNA) and does not hybridize with the guide sequence of the guide RNA (i.e., the detector ssDNA is a non-target ssDNA). Such methods can include (a) contacting the sample with: (i) a CasZ polypeptide or a CasY polypeptide; (ii) a guide RNA comprising: a region that binds to the CasZ polypeptide or the CasY polypeptide, and a guide sequence that hybridizes with the target DNA; and (iii) a detector DNA that is single stranded and does not hybridize with the guide sequence of the guide RNA; and (b) measuring a detectable signal produced by cleavage of the single stranded detector DNA by the CasZ polypeptide or the CasY polypeptide, thereby detecting the target DNA. In some cases, the methods include can include (a) contacting the sample with: (i) a CasZ polypeptide; (ii) a guide RNA comprising: a region that binds to the CasZ polypeptide, and a guide sequence that hybridizes with the target DNA; (iii) a CasZ tranc RNA; and (iv) a detector DNA that is single stranded and does not hybridize with the guide sequence of the guide RNA; and (b) measuring a detectable signal produced by cleavage of the single stranded detector DNA by the CasZ polypeptide, thereby detecting the target DNA. In some cases, the methods include can include (a) contacting the sample with: (i) a CasY polypeptide; (ii) a guide RNA comprising: a region that binds to the CasY polypeptide, and a guide sequence that hybridizes with the target DNA; (iii) a CasY tranc RNA; and (iv) a detector DNA that is single stranded and does not hybridize with the guide sequence of the guide RNA; and (b) measuring a detectable signal produced by cleavage of the single stranded detector DNA by the CasY polypeptide, thereby detecting the target DNAAs noted above, once a subject CasZ polypeptide or a subject CasY polypeptide is activated by a guide RNA (and in some cases also a trancRNA), which occurs when the sample includes a target DNA to which the guide RNA hybridizes (i.e., the sample includes the targeted target DNA), the CasZ polypeptide or the CasY polypeptide is activated and functions as an endoribonuclease that non-specifically cleaves ssDNAs (including non-target ssDNAs) present in the sample. Thus, when the targeted target DNA is present in the sample (e.g., in some cases above a threshold amount), the result is cleavage of ssDNA (including non-target ssDNA) in the sample, which can be detected using any convenient detection method (e.g., using a labeled detector ssDNA).

Also provided are compositions and methods for cleaving single stranded DNAs (ssDNAs) (e.g., non-target ssDNAs). Such methods can include contacting a population of nucleic acids, wherein said population comprises a target DNA and a plurality of non-target ssDNAs, with: (i) a CasZ polypeptide or a CasY polypeptide; and (ii) a guide RNA comprising: a region that binds to the CasZ polypeptide or the CasY polypeptide, and a guide sequence that hybridizes with the target DNA, wherein the CasZ polypeptide cleaves non-target ssDNAs of said plurality. Such methods can include contacting a population of nucleic acids, wherein said population comprises a target DNA and a plurality of non-target ssDNAs, with: (i) a CasZ polypeptide or a; (ii) a guide RNA comprising: a region that binds to the CasZ polypeptide, and a guide sequence that hybridizes with the target DNA, and (iii) a CasZ tranc RNA, wherein the CasZ polypeptide cleaves non-target ssDNAs of said plurality. The methods can include contacting a population of nucleic acids, wherein said population comprises a target DNA and a plurality of non-target ssDNAs, with: (i) a CasY polypeptide or a; (ii) a guide RNA comprising: a region that binds to the CasY polypeptide, and a guide sequence that hybridizes with the target DNA, and (iii) a CasY tranc RNA, wherein the CasY polypeptide cleaves non-target ssDNAs of said plurality. Such methods can be used, e.g., to cleave foreign ssDNAs (e.g., viral DNAs) in a cell.

The contacting step of a subject method can be carried out in a composition comprising divalent metal ions. The contacting step can be carried out in an acellular environment, e.g., outside of a cell. The contacting step can be carried out inside a cell. The contacting step can be carried out in a cell in vitro. The contacting step can be carried out in a cell ex vivo. The contacting step can be carried out in a cell in vivo.

The guide RNA can be provided as RNA or as a nucleic acid encoding the guide RNA (e.g., a DNA such as a recombinant expression vector). The tranc RNA can be provided as RNA or as a nucleic acid encoding the guide RNA (e.g., a DNA such as a recombinant expression vector). The CasZ polypeptide can be provided as a protein per se or as a nucleic acid encoding the protein (e.g., an mRNA, a DNA such as a recombinant expression vector). In some cases, two or more (e.g., 3 or more, 4 or more, 5 or more, or 6 or more) guide RNAs can be provided. In some cases, a single-molecule RNA comprising: i) a CasZ guide RNA; and ii) a tranc RNA (or a nucleic acid comprising a nucleotide sequence encoding the single-molecule RNA) is used. In some cases, a single-molecule RNA comprising: i) a CasY guide RNA; and ii) a tranc RNA (or a nucleic acid comprising a nucleotide sequence encoding the single-molecule RNA) is used.

In some cases (e.g., when contacting a sample with a guide RNA and a CasZ polypeptide; or when contacting a sample with a guide RNA, a CasZ polypeptide, and a tranc RNA; or when contacting a sample with a guide RNA and a CasY polypeptide; or when contacting a sample with a guide RNA, a CasY polypeptide, and a tranc RNA)), the sample is contacted for 2 hours or less (e.g., 1.5 hours or less, 1 hour or less, 40 minutes or less, 30 minutes or less, 20 minutes or less, 10 minutes or less, or 5 minutes or less, or 1 minute or less) prior to the measuring step. For example, in some cases the sample is contacted for 40 minutes or less prior to the measuring step. In some cases, the sample is contacted for 20 minutes or less prior to the measuring step. In some cases, the sample is contacted for 10 minutes or less prior to the measuring step. In some cases, the sample is contacted for 5 minutes or less prior to the measuring step. In some cases, the sample is contacted for 1 minute or less prior to the measuring step. In some cases, the sample is contacted for from 50 seconds to 60 seconds prior to the measuring step. In some cases, the sample is contacted for from 40 seconds to 50 seconds prior to the measuring step. In some cases, the sample is contacted for from 30 seconds to 40 seconds prior to the measuring step. In some cases, the sample is contacted for from 20 seconds to 30 seconds prior to the measuring step. In some cases, the sample is contacted for from 10 seconds to 20 seconds prior to the measuring step.

In some cases, a method of the present disclosure for detecting a target DNA comprises: a) contacting a sample with a guide RNA, a CasZ polypeptide, and a detector DNA), where the sample is contacted for 2 hours or less (e.g., 1.5 hours or less, 1 hour or less, 40 minutes or less, 30 minutes or less, 20 minutes or less, 10 minutes or less, or 5 minutes or less, or 1 minute or less), under conditions that provide for trans cleavage of the detector DNA; b) maintaining the sample from step (a) for a period of time under conditions that do not provide for trans cleavage of the detector RNA; and c) after the time period of step (b), measuring a detectable signal produced by cleavage of the single stranded detector DNA by the CasZ polypeptide, thereby detecting the target DNA. Conditions that provide for trans cleavage of the detector DNA include temperature conditions such as from 17° C. to about 39° C. (e.g., about 37° C.). Conditions that do not provide for trans cleavage of the detector DNA include temperatures of 10° C. or less, 5° C. or less, 4° C. or less, or 0° C.

In some cases, a method of the present disclosure for detecting a target DNA comprises: a) contacting a sample with a guide RNA, a CasY polypeptide, and a detector DNA), where the sample is contacted for 2 hours or less (e.g., 1.5 hours or less, 1 hour or less, 40 minutes or less, 30 minutes or less, 20 minutes or less, 10 minutes or less, or 5 minutes or less, or 1 minute or less), under conditions that provide for trans cleavage of the detector DNA; b) maintaining the sample from step (a) for a period of time under conditions that do not provide for trans cleavage of the detector RNA; and c) after the time period of step (b), measuring a detectable signal produced by cleavage of the single stranded detector DNA by the CasY polypeptide, thereby detecting the target DNA. Conditions that provide for trans cleavage of the detector DNA include temperature conditions such as from 17° C. to about 39° C. (e.g., about 37° C.). Conditions that do not provide for trans cleavage of the detector DNA include temperatures of 10° C. or less, 5° C. or less, 4° C. or less, or 0° C.

In some cases, a method of the present disclosure for detecting a target DNA comprises: a) contacting a sample with a guide RNA, a tranc RNA, a CasZ polypeptide, and a detector DNA (or contacting a sample with: i) a single-molecule RNA comprising a guide RNA and a tranc RNA; i) a CasZ polypeptide; and iii) a detector DNA), where the sample is contacted for 2 hours or less (e.g., 1.5 hours or less, 1 hour or less, 40 minutes or less, 30 minutes or less, 20 minutes or less, 10 minutes or less, or 5 minutes or less, or 1 minute or less), under conditions that provide for trans cleavage of the detector DNA; b) maintaining the sample from step (a) for a period of time under conditions that do not provide for trans cleavage of the detector RNA; and c) after the time period of step (b), measuring a detectable signal produced by cleavage of the single stranded detector DNA by the CasZ polypeptide, thereby detecting the target DNA. Conditions that provide for trans cleavage of the detector DNA include temperature conditions such as from 17° C. to about 39° C. (e.g., about 37° C.). Conditions that do not provide for trans cleavage of the detector DNA include temperatures of 10° C. or less, 5° C. or less, 4° C. or less, or 0° C.

In some cases, a method of the present disclosure for detecting a target DNA comprises: a) contacting a sample with a guide RNA, a tranc RNA, a CasY polypeptide, and a detector DNA (or contacting a sample with: i) a single-molecule RNA comprising a guide RNA and a tranc RNA; i) a CasY polypeptide; and iii) a detector DNA), where the sample is contacted for 2 hours or less (e.g., 1.5 hours or less, 1 hour or less, 40 minutes or less, 30 minutes or less, 20 minutes or less, 10 minutes or less, or 5 minutes or less, or 1 minute or less), under conditions that provide for trans cleavage of the detector DNA; b) maintaining the sample from step (a) for a period of time under conditions that do not provide for trans cleavage of the detector RNA; and c) after the time period of step (b), measuring a detectable signal produced by cleavage of the single stranded detector DNA by the CasY polypeptide, thereby detecting the target DNA. Conditions that provide for trans cleavage of the detector DNA include temperature conditions such as from 17° C. to about 39° C. (e.g., about 37° C.). Conditions that do not provide for trans cleavage of the detector DNA include temperatures of 10° C. or less, 5° C. or less, 4° C. or less, or 0° C.

In some cases, a detectable signal produced by cleavage of a single-stranded detector DNA is produced for no more than 60 minutes. For example, in some cases, a detectable signal produced by cleavage of a single-stranded detector DNA is produced for no more than 60 minutes, no more than 45 minutes, no more than 30 minutes, no more than 15 minutes, no more than 10 minutes, or no more than 5 minutes. For example, in some cases, a detectable signal produced by cleavage of a single-stranded detector DNA is produced for a period of time of from 1 minute to 60 minutes, e.g., from 1 minute to 5 minutes, from 5 minutes to 10 minutes, from 10 minutes to 15 minutes, from 15 minutes to 30 minutes, from 30 minutes to 45 minutes, or from 45 minutes to 60 minutes. In some cases, after the detectable signal is produced (e.g., produced for no more than 60 minutes), production of the detectable signal can be stopped, e.g., by lowering the temperature of the sample (e.g., lowering the temperature to 10° C. or less, 5° C. or less, 4° C. or less, or 0° C.), by adding an inhibitor to the sample, by lyophilizing the sample, by heating the sample to over 40° C., and the like. The measuring step can occur at any time after production of the detectable signal has been stopped. For example, the measuring step can occur from 5 minutes to 48 hours after production of the detectable signal has been stopped. For example, the measuring step can occur from 5 minutes to 15 minutes, from 15 minutes to 30 minutes, from 30 minutes to 60 minutes, from 1 hour to 4 hours, from 4 hours to 8 hours, from 8 hours to 12 hours, from 12 hours to 24 hours, from 24 hours to 36 hours, or from 36 hours to 48 hours, after production of the detectable signal has been stopped. The measuring step can occur more than 48 hours after production of the detectable signal has been stopped.

A method of the present disclosure for detecting a target DNA (single-stranded or double-stranded) in a sample can detect a target DNA with a high degree of sensitivity. In some cases, a method of the present disclosure can be used to detect a target DNA present in a sample comprising a plurality of DNAs (including the target DNA and a plurality of non-target DNAs), where the target DNA is present at one or more copies per $10^7$ non-target DNAs (e.g., one or more copies per $10^6$ non-target DNAs, one or more copies per $10^5$ non-target DNAs, one or more copies per $10^4$ non-target DNAs, one or more copies per $10^3$ non-target DNAs, one or more copies per $10^2$ non-target DNAs, one or more copies per 50 non-target DNAs, one or more copies per 20 non-target DNAs, one or more copies per 10 non-target DNAs, or one or more copies per 5 non-target DNAs). In some cases, a method of the present disclosure can be used to detect a target DNA present in a sample comprising a plurality of DNAs (including the target DNA and a plurality of non-target DNAs), where the target DNA is present at one or more copies per $10^{18}$ non-target DNAs (e.g., one or more copies per $10^{15}$ non-target DNAs, one or more copies per $10^{12}$ non-target DNAs, one or more copies per $10^9$ non-target DNAs, one or more copies per $10^6$ non-target DNAs, one or more copies per $10^5$ non-target DNAs, one or more copies per $10^4$ non-target DNAs, one or more copies per $10^3$ non-target DNAs, one or more copies per $10^2$ non-target DNAs, one or more copies per 50 non-target DNAs, one or more copies per 20 non-target DNAs, one or more copies per 10 non-target DNAs, or one or more copies per 5 non-target DNAs).

In some cases, a method of the present disclosure can detect a target DNA present in a sample, where the target DNA is present at from one copy per $10^7$ non-target DNAs to one copy per 10 non-target DNAs (e.g., from 1 copy per $10^7$ non-target DNAs to 1 copy per $10^2$ non-target DNAs, from 1 copy per $10^7$ non-target DNAs to 1 copy per $10^3$ non-target DNAs, from 1 copy per $10^7$ non-target DNAs to 1 copy per $10^4$ non-target DNAs, from 1 copy per $10^7$ non-target DNAs to 1 copy per $10^5$ non-target DNAs, from 1 copy per $10^7$ non-target DNAs to 1 copy per $10^6$ non-target DNAs, from 1 copy per $10^6$ non-target DNAs to 1 copy per 10 non-target DNAs, from 1 copy per $10^6$ non-target DNAs to 1 copy per $10^2$ non-target DNAs, from 1 copy per $10^6$ non-target DNAs to 1 copy per $10^3$ non-target DNAs, from 1 copy per $10^6$ non-target DNAs to 1 copy per $10^4$ non-target DNAs, from 1 copy per $10^6$ non-target DNAs to 1 copy per $10^5$ non-target DNAs, from 1 copy per $10^5$ non-target DNAs to 1 copy per 10 non-target DNAs, from 1 copy per $10^5$ non-target DNAs to 1 copy per $10^2$ non-target DNAs, from 1 copy per $10^5$ non-target DNAs to 1 copy per $10^3$ non-target DNAs, or from 1 copy per $10^5$ non-target DNAs to 1 copy per $10^4$ non-target DNAs).

In some cases, a method of the present disclosure can detect a target DNA present in a sample, where the target DNA is present at from one copy per $10^{18}$ non-target DNAs to one copy per 10 non-target DNAs (e.g., from 1 copy per $10^{18}$ non-target DNAs to 1 copy per $10^2$ non-target DNAs, from 1 copy per $10^{15}$ non-target DNAs to 1 copy per $10^2$ non-target DNAs, from 1 copy per $10^{12}$ non-target DNAs to 1 copy per $10^2$ non-target DNAs, from 1 copy per $10^9$ non-target DNAs to 1 copy per $10^2$ non-target DNAs, from 1 copy per $10^7$ non-target DNAs to 1 copy per $10^2$ non-target DNAs, from 1 copy per $10^7$ non-target DNAs to 1 copy per $10^3$ non-target DNAs, from 1 copy per $10^7$ non-target DNAs to 1 copy per $10^4$ non-target DNAs, from 1 copy per $10^7$ non-target DNAs to 1 copy per $10^5$ non-target DNAs, from 1 copy per $10^7$ non-target DNAs to 1 copy per $10^6$ non-target DNAs, from 1 copy per $10^6$ non-target DNAs to 1 copy per 10 non-target DNAs, from 1 copy per $10^6$ non-target DNAs to 1 copy per $10^2$ non-target DNAs, from 1 copy per $10^6$ non-target DNAs to 1 copy per $10^3$ non-target DNAs, from 1 copy per $10^6$ non-target DNAs to 1 copy per $10^4$ non-target DNAs, from 1 copy per $10^6$ non-target DNAs to 1 copy per $10^5$ non-target DNAs, from 1 copy per $10^5$ non-target DNAs to 1 copy per 10 non-target DNAs, from 1 copy per $10^5$ non-target DNAs to 1 copy per $10^2$ non-target DNAs, from 1 copy per $10^5$ non-target DNAs to 1 copy per $10^2$ non-target DNAs, or from 1 copy per $10^5$ non-target DNAs to 1 copy per $10^4$ non-target DNAs).

In some cases, a method of the present disclosure can detect a target DNA present in a sample, where the target DNA is present at from one copy per $10^7$ non-target DNAs to one copy per 100 non-target DNAs (e.g., from 1 copy per $10^7$ non-target DNAs to 1 copy per $10^2$ non-target DNAs, from 1 copy per $10^7$ non-target DNAs to 1 copy per $10^3$ non-target DNAs, from 1 copy per $10^7$ non-target DNAs to 1 copy per $10^4$ non-target DNAs, from 1 copy per $10^7$ non-target DNAs to 1 copy per $10^5$ non-target DNAs, from 1 copy per 10' non-target DNAs to 1 copy per $10^6$ non-target DNAs, from 1 copy per $10^6$ non-target DNAs to 1 copy per 100 non-target DNAs, from 1 copy per $10^6$ non-target DNAs to 1 copy per $10^2$ non-target DNAs, from 1 copy per $10^6$ non-target DNAs to 1 copy per $10^3$ non-target DNAs, from 1 copy per $10^6$ non-target DNAs to 1 copy per $10^4$ non-target DNAs, from 1 copy per $10^6$ non-target DNAs to 1 copy per $10^5$ non-target DNAs, from 1 copy per $10^5$ non-target DNAs to 1 copy per 100 non-target DNAs, from 1 copy per $10^5$ non-target DNAs to 1 copy per $10^2$ non-target DNAs, from 1 copy per $10^5$ non-target DNAs to 1 copy per $10^3$ non-target DNAs, or from 1 copy per $10^5$ non-target DNAs to 1 copy per $10^4$ non-target DNAs).

In some cases, the threshold of detection, for a subject method of detecting a target DNA in a sample, is 10 nM or less. Thus, e.g., the target DNA can be present in the sample in a concentration of 10 nM or less. The term "threshold of detection" is used herein to describe the minimal amount of target DNA that must be present in a sample in order for detection to occur. Thus, as an illustrative example, when a threshold of detection is 10 nM, then a signal can be detected when a target DNA is present in the sample at a concentration of 10 nM or more. In some cases, a method of the present disclosure has a threshold of detection of 5 nM or less. In some cases, a method of the present disclosure has a threshold of detection of 1 nM or less. In some cases, a method of the present disclosure has a threshold of detection of 0.5 nM or less. In some cases, a method of the present disclosure has a threshold of detection of 0.1 nM or less. In some cases, a method of the present disclosure has a threshold of detection of 0.05 nM or less. In some cases, a method of the present disclosure has a threshold of detection of 0.01 nM or less. In some cases, a method of the present disclosure has a threshold of detection of 0.005 nM or less. In some cases, a method of the present disclosure has a threshold of detection of 0.001 nM or less. In some cases, a method of the present disclosure has a threshold of detection of 0.0005 nM or less. In some cases, a method of the present disclosure has a threshold of detection of 0.0001 nM or less. In some cases, a method of the present disclosure has a threshold of detection of 0.00005 nM or less. In some cases, a method of the present disclosure has a threshold of detection of 0.00001 nM or less. In some cases, a method of the present disclosure has a threshold of detection of 10 pM or less. In some cases, a method of the present disclosure has a threshold of detection of 1 pM or less. In some cases, a method of the present disclosure has a threshold of detection of 500 fM or less. In some cases, a method of the present disclosure has a threshold of detection of 250 fM or less. In some cases, a method of the present disclosure has a threshold of detection of 100 fM or less. In some cases, a method of the present disclosure has a threshold of detection of 50 fM or less. In some cases, a method of the present disclosure has a threshold of detection of 500 aM (attomolar) or less. In some cases, a method of the present disclosure has a threshold of detection of 250 aM or less. In some cases, a method of the present disclosure has a threshold of detection of 100 aM or less. In some cases, a method of the present disclosure has a threshold of detection of 50 aM or less. In some cases, a method of the present disclosure has a threshold of detection of 10 aM or less. In some cases, a method of the present disclosure has a threshold of detection of 1 aM or less.

In some cases, the threshold of detection (for detecting the target DNA in a subject method), is in a range of from 500 fM to 1 nM (e.g., from 500 fM to 500 pM, from 500 fM to 200 pM, from 500 fM to 100 pM, from 500 fM to 10 pM, from 500 fM to 1 pM, from 800 fM to 1 nM, from 800 fM to 500 pM, from 800 fM to 200 pM, from 800 fM to 100 pM, from 800 fM to 10 pM, from 800 fM to 1 pM, from 1 pM to 1 nM, from 1 pM to 500 pM, from 1 pM to 200 pM, from 1 pM to 100 pM, or from 1 pM to 10 pM) (where the concentration refers to the threshold concentration of target DNA at which the target DNA can be detected). In some cases, a method of the present disclosure has a threshold of detection in a range of from 800 fM to 100 pM. In some cases, a method of the present disclosure has a threshold of detection in a range of from 1 pM to 10 pM. In some cases, a method of the present disclosure has a threshold of detection in a range of from 10 fM to 500 fM, e.g., from 10 fM to 50 fM, from 50 fM to 100 fM, from 100 fM to 250 fM, or from 250 fM to 500 fM.

In some cases, the minimum concentration at which a target DNA can be detected in a sample is in a range of from 500 fM to 1 nM (e.g., from 500 fM to 500 pM, from 500 fM to 200 pM, from 500 fM to 100 pM, from 500 fM to 10 pM, from 500 fM to 1 pM, from 800 fM to 1 nM, from 800 fM to 500 pM, from 800 fM to 200 pM, from 800 fM to 100 pM, from 800 fM to 10 pM, from 800 fM to 1 pM, from 1 pM to 1 nM, from 1 pM to 500 pM, from 1 pM to 200 pM, from 1 pM to 100 pM, or from 1 pM to 10 pM). In some cases, the minimum concentration at which a target DNA can be detected in a sample is in a range of from 800 fM to 100 pM. In some cases, the minimum concentration at which a target DNA can be detected in a sample is in a range of from 1 pM to 10 pM.

In some cases, the threshold of detection (for detecting the target DNA in a subject method), is in a range of from 1 aM to 1 nM (e.g., from 1 aM to 500 pM, from 1 aM to 200 pM, from 1 aM to 100 pM, from 1 aM to 10 pM, from 1 aM to 1 pM, from 100 aM to 1 nM, from 100 aM to 500 pM, from 100 aM to 200 pM, from 100 aM to 100 pM, from 100 aM to 10 pM, from 100 aM to 1 pM, from 250 aM to 1 nM, from 250 aM to 500 pM, from 250 aM to 200 pM, from 250 aM to 100 pM, from 250 aM to 10 pM, from 250 aM to 1 pM, from 500 aM to 1 nM, from 500 aM to 500 pM, from 500 aM to 200 pM, from 500 aM to 100 pM, from 500 aM to 10 pM, from 500 aM to 1 pM, from 750 aM to 1 nM, from 750 aM to 500 pM, from 750 aM to 200 pM, from 750 aM to 100 pM, from 750 aM to 10 pM, from 750 aM to 1 pM, from 1 fM to 1 nM, from 1 fM to 500 pM, from 1 fM to 200 pM, from 1 fM to 100 pM, from 1 fM to 10 pM, from 1 fM to 1 pM, from 500 fM to 500 pM, from 500 fM to 200 pM, from 500 fM to 100 pM, from 500 fM to 10 pM, from 500 fM to 1 pM, from 800 fM to 1 nM, from 800 fM to 500 pM, from 800 fM to 200 pM, from 800 fM to 100 pM, from 800 fM to 10 pM, from 800 fM to 1 pM, from 1 pM to 1 nM, from 1 pM to 500 pM, from 1 pM to 200 pM, from 1 pM to 100 pM, or from 1 pM to 10 pM) (where the concentration refers to the threshold concentration of target DNA at which the target DNA can be detected). In some cases, a method of the present disclosure has a threshold of detection in a range of from 1 aM to 800 aM. In some cases, a method of the present disclosure has a threshold of detection in a range of from 50 aM to 1 pM. In some cases, a method of the present disclosure has a threshold of detection in a range of from 50 aM to 500 fM.

In some cases, a target DNA is present in a sample in a range of from 1 aM to 1 nM (e.g., from 1 aM to 500 pM, from 1 aM to 200 pM, from 1 aM to 100 pM, from 1 aM to 10 pM, from 1 aM to 1 pM, from 100 aM to 1 nM, from 100 aM to 500 pM, from 100 aM to 200 pM, from 100 aM to 100 pM, from 100 aM to 10 pM, from 100 aM to 1 pM, from 250 aM to 1 nM, from 250 aM to 500 pM, from 250 aM to 200 pM, from 250 aM to 100 pM, from 250 aM to 10 pM, from 250 aM to 1 pM, from 500 aM to 1 nM, from 500 aM to 500 pM, from 500 aM to 200 pM, from 500 aM to 100 pM, from 500 aM to 10 pM, from 500 aM to 1 pM, from 750 aM to 1 nM, from 750 aM to 500 pM, from 750 aM to 200 pM, from 750 aM to 100 pM, from 750 aM to 10 pM, from 750 aM to 1 pM, from 1 fM to 1 nM, from 1 fM to 500 pM, from 1 fM to 200 pM, from 1 fM to 100 pM, from 1 fM to 10 pM, from 1 fM to 1 pM, from 500 fM to 500 pM, from 500 fM to 200 pM, from 500 fM to 100 pM, from 500 fM to 10 pM, from 500 fM to 1 pM, from 800 fM to 1 nM, from 800 fM to 500 pM, from 800 fM to 200 pM, from 800 fM to 100 pM, from 800 fM to 10 pM, from 800 fM to 1 pM, from 1 pM to 1 nM, from 1 pM to 500 pM, from 1 pM to 200 pM, from 1 pM to 100 pM, or from 1 pM to 10 pM). In some cases, a target DNA is present in a sample in a range of from 1 aM to 800 aM. In some cases, a target DNA is present in a sample in a range of from 50 aM to 1 pM. In some cases, a target DNA is present in a sample in a range of from 50 aM to 500 fM.

In some cases, the minimum concentration at which a target DNA can be detected in a sample is in a range of from 1 aM to 1 nM (e.g., from 1 aM to 500 pM, from 1 aM to 200 pM, from 1 aM to 100 pM, from 1 aM to 10 pM, from 1 aM to 1 pM, from 100 aM to 1 nM, from 100 aM to 500 pM, from 100 aM to 200 pM, from 100 aM to 100 pM, from 100 aM to 10 pM, from 100 aM to 1 pM, from 250 aM to 1 nM, from 250 aM to 500 pM, from 250 aM to 200 pM, from 250 aM to 100 pM, from 250 aM to 10 pM, from 250 aM to 1 pM, from 500 aM to 1 nM, from 500 aM to 500 pM, from 500 aM to 200 pM, from 500 aM to 100 pM, from 500 aM to 10 pM, from 500 aM to 1 pM, from 750 aM to 1 nM, from 750 aM to 500 pM, from 750 aM to 200 pM, from 750 aM to 100 pM, from 750 aM to 10 pM, from 750 aM to 1 pM, from 1 fM to 1 nM, from 1 fM to 500 pM, from 1 fM to 200 pM, from 1 fM to 100 pM, from 1 fM to 10 pM, from 1 fM to 1 pM, from 500 fM to 500 pM, from 500 fM to 200 pM, from 500 fM to 100 pM, from 500 fM to 10 pM, from 500 fM to 1 pM, from 800 fM to 1 nM, from 800 fM to 500 pM, from 800 fM to 200 pM, from 800 fM to 100 pM, from 800 fM to 10 pM, from 800 fM to 1 pM, from 1 pM to 1 nM, from 1 pM to 500 pM, from 1 pM to 200 pM, from 1 pM to 100 pM, or from 1 pM to 10 pM). In some cases, the minimum concentration at which a target DNA can be detected in a sample is in a range of from 1 aM to 500 pM. In some cases, the minimum concentration at which a target DNA can be detected in a sample is in a range of from 100 aM to 500 pM.

In some cases, a target DNA is present in a sample in a range of from 1 aM to 1 nM (e.g., from 1 aM to 500 pM, from 1 aM to 200 pM, from 1 aM to 100 pM, from 1 aM to 10 pM, from 1 aM to 1 pM, from 100 aM to 1 nM, from 100 aM to 500 pM, from 100 aM to 200 pM, from 100 aM to 100 pM, from 100 aM to 10 pM, from 100 aM to 1 pM, from 250 aM to 1 nM, from 250 aM to 500 pM, from 250 aM to 200 pM, from 250 aM to 100 pM, from 250 aM to 10 pM, from 250 aM to 1 pM, from 500 aM to 1 nM, from 500 aM to 500 pM, from 500 aM to 200 pM, from 500 aM to 100 pM, from 500 aM to 10 pM, from 500 aM to 1 pM, from 750 aM to 1 nM, from 750 aM to 500 pM, from 750 aM to 200 pM, from 750 aM to 100 pM, from 750 aM to 10 pM, from 750 aM to 1 pM, from 1 fM to 1 nM, from 1 fM to 500 pM, from 1 fM to 200 pM, from 1 fM to 100 pM, from 1 fM to 10 pM, from 1 fM to 1 pM, from 500 fM to 500 pM, from 500 fM to 200 pM, from 500 fM to 100 pM, from 500 fM to 10 pM, from 500 fM to 1 pM, from 800 fM to 1 nM, from 800 fM to 500 pM, from 800 fM to 200 pM, from 800 fM to 100 pM, from 800 fM to 10 pM, from 800 fM to 1 pM, from 1 pM to 1 nM, from 1 pM to 500 pM, from 1 pM to 200 pM, from 1 pM to 100 pM, or from 1 pM to 10 pM). In some cases, a target DNA is present in a sample in a range of from 1 aM to 500 pM. In some cases, a target DNA is present in a sample in a range of from 100 aM to 500 pM.

In some cases, a subject composition or method exhibits an attomolar (aM) sensitivity of detection. In some cases, a subject composition or method exhibits a femtomolar (fM) sensitivity of detection. In some cases, a subject composition or method exhibits a picomolar (pM) sensitivity of detection. In some cases, a subject composition or method exhibits a nanomolar (nM) sensitivity of detection.

Target DNA

A target DNA can be single stranded (ssDNA) or double stranded (dsDNA). When the target DNA is single stranded, there is no preference or requirement for a PAM sequence in the target DNA. However, when the target DNA is dsDNA, a PAM is usually present adjacent to the target sequence of the target DNA (e.g., see discussion of the PAM elsewhere herein). The source of the target DNA can be the same as the source of the sample, e.g., as described below.

The source of the target DNA can be any source. In some cases, the target DNA is a viral DNA (e.g., a genomic DNA of a DNA virus). As such, subject method can be for detecting the presence of a viral DNA amongst a population of nucleic acids (e.g., in a sample). A subject method can also be used for the cleavage of non-target ssDNAs in the present of a target DNA. For example, if a method takes place in a cell, a subject method can be used to promiscuously cleave non-target ssDNAs in the cell (ssDNAs that do not hybridize with the guide sequence of the guide RNA) when a particular target DNA is present in the cell (e.g., when the cell is infected with a virus and viral target DNA is detected).

Examples of possible target DNAs include, but are not limited to, viral DNAs such as: a papovavirus (e.g., human papillomavirus (HPV), polyomavirus); a hepadnavirus (e.g., Hepatitis B Virus (HBV)); a herpesvirus (e.g., herpes simplex virus (HSV), varicella zoster virus (VZV), Epstein-Barr virus (EBV), cytomegalovirus (CMV), herpes lymphotropic virus, *Pityriasis Rosea*, kaposi's sarcoma-associated herpesvirus); an adenovirus (e.g., atadenovirus, aviadenovirus, ichtadenovirus, mastadenovirus, siadenovirus); a poxvirus (e.g., smallpox, vaccinia virus, cowpox virus, monkeypox virus, orf virus, pseudocowpox, bovine papular stomatitis virus; tanapox virus, yaba monkey tumor virus; molluscum contagiosum virus (MCV)); a parvovirus (e.g., adeno-associated virus (AAV), Parvovirus B19, human bocavirus, bufavirus, human parv4 G1); Geminiviridae; Nanoviridae; Phycodnaviridae; and the like. In some cases, the target DNA is parasite DNA. In some cases, the target DNA is bacterial DNA, e.g., DNA of a pathogenic bacterium.

Samples

A subject sample includes nucleic acid (e.g., a plurality of nucleic acids). The term "plurality" is used herein to mean two or more. Thus, in some cases a sample includes two or more (e.g., 3 or more, 5 or more, 10 or more, 20 or more, 50 or more, 100 or more, 500 or more, 1,000 or more, or 5,000 or more) nucleic acids (e.g., DNAs). A subject method can be used as a very sensitive way to detect a target DNA present in a sample (e.g., in a complex mixture of nucleic acids such as DNAs). In some cases, the sample includes 5 or more DNAs (e.g., 10 or more, 20 or more, 50 or more, 100 or more, 500 or more, 1,000 or more, or 5.000 or more DNAs) that differ from one another in sequence. In some cases, the sample includes 10 or more, 20 or more, 50 or more, 100 or more, 500 or more, $10^3$ or more, $5\times10^3$ or more, $10^4$ or more, $5\times10^4$ or more, $10^5$ or more, $5\times10^5$ or more, $10^6$ or more $5\times10^6$ or more, or $10^7$ or more, DNAs. In some cases, the sample comprises from 10 to 20, from 20 to 50, from 50 to 100, from 100 to 500, from 500 to $10^3$, from $10^3$ to $5\times10^3$, from $5\times10^3$ to $10^4$, from $10^4$ to $5\times10^4$, from $5\times10^4$ to $10^5$, from $10^5$ to $5\times10^5$, from $5\times10^5$ to $10^6$, from $10^6$ to $5\times10^6$, or from $5\times10^6$ to $10^7$, or more than $10^7$, DNAs. In some cases, the sample comprises from 5 to 10' DNAs (e.g., that differ from one another in sequence)(e.g., from 5 to $10^6$, from 5 to $10^5$, from 5 to 50,000, from 5 to 30,000, from 10 to $10^6$, from 10 to $10^5$, from 10 to 50,000, from 10 to 30,000, from 20 to $10^6$, from 20 to $10^5$, from 20 to 50,000, or from 20 to 30,000 DNAs). In some cases, the sample includes 20 or more DNAs that differ from one another in sequence. In some cases, the sample includes DNAs from a cell lysate (e.g., a eukaryotic cell lysate, a mammalian cell lysate, a human cell lysate, a prokaryotic cell lysate, a plant cell lysate, and the like). For example, in some cases the sample includes DNA from a cell such as a eukaryotic cell, e.g., a mammalian cell such as a human cell.

The term "sample" is used herein to mean any sample that includes DNA (e.g., in order to determine whether a target DNA is present among a population of DNAs). The sample can be derived from any source, e.g., the sample can be a synthetic combination of purified DNAs; the sample can be a cell lysate, an DNA-enriched cell lysate, or DNAs isolated and/or purified from a cell lysate. The sample can be from a patient (e.g., for the purpose of diagnosis). The sample can be from permeabilized cells. The sample can be from crosslinked cells. The sample can be in tissue sections. The sample can be from tissues prepared by crosslinking followed by dclipidation and adjustment to make a uniform refractive index. Examples of tissue preparation by crosslinking followed by delipidation and adjustment to make a uniform refractive index have been described in, for example, Shah et al., Development (2016) 143, 2862-2867 doi:10.1242/dev.138560.

A "sample" can include a target DNA and a plurality of non-target DNAs. In some cases, the target DNA is present in the sample at one copy per 10 non-target DNAs, one copy per 20 non-target DNAs, one copy per 25 non-target DNAs, one copy per 50 non-target DNAs, one copy per 100 non-target DNAs, one copy per 500 non-target DNAs, one copy per $10^3$ non-target DNAs, one copy per $5\times10^3$ non-target DNAs, one copy per $10^4$ non-target DNAs, one copy per $5\times10^4$ non-target DNAs, one copy per $10^5$ non-target DNAs, one copy per $5\times10^5$ non-target DNAs, one copy per $10^6$ non-target DNAs, or less than one copy per $10^6$ non-target DNAs. In some cases, the target DNA is present in the sample at from one copy per 10 non-target DNAs to 1 copy per 20 non-target DNAs, from 1 copy per 20 non-target DNAs to 1 copy per 50 non-target DNAs, from 1 copy per 50 non-target DNAs to 1 copy per 100 non-target DNAs, from 1 copy per 100 non-target DNAs to 1 copy per 500 non-target DNAs, from 1 copy per 500 non-target DNAs to 1 copy per $10^3$ non-target DNAs, from 1 copy per $10^3$ non-target DNAs to 1 copy per $5\times10^3$ non-target DNAs, from 1 copy per $5\times10^3$ non-target DNAs to 1 copy per $10^4$ non-target DNAs, from 1 copy per $10^4$ non-target DNAs to 1 copy per $10^5$ non-target DNAs, from 1 copy per $10^5$ non-target DNAs to 1 copy per $10^6$ non-target DNAs, or from 1 copy per $10^6$ non-target DNAs to 1 copy per $10^7$ non-target DNAs.

Suitable samples include but are not limited to saliva, blood, serum, plasma, urine, aspirate, and biopsy samples. Thus, the term "sample" with respect to a patient encompasses blood and other liquid samples of biological origin, solid tissue samples such as a biopsy specimen or tissue cultures or cells derived therefrom and the progeny thereof. The definition also includes samples that have been manipulated in any way after their procurement, such as by treatment with reagents; washed; or enrichment for certain cell populations, such as cancer cells. The definition also includes sample that have been enriched for particular types of molecules, e.g., DNAs. The term "sample" encompasses biological samples such as a clinical sample such as blood, plasma, serum, aspirate, cerebral spinal fluid (CSF), and also includes tissue obtained by surgical resection, tissue obtained by biopsy, cells in culture, cell supernatants, cell lysates, tissue samples, organs, hone marrow, and the like. A "biological sample" includes biological fluids derived therefrom (e.g., cancerous cell, infected cell, etc.), e.g., a sample comprising DNAs that is obtained from such cells (e.g., a cell lysate or other cell extract comprising DNAs).

A sample can comprise, or can be obtained from, any of a variety of cells, tissues, organs, or acellular fluids. Suitable sample sources include eukaryotic cells, bacterial cells, and archaeal cells. Suitable sample sources include single-celled organisms and multi-cellular organisms. Suitable sample sources include single-cell eukaryotic organisms; a plant or a plant cell; an algal cell, e.g., *Botryococcus braunii, Chlamydomonas reinhardtii, Nannochloropsis gaditana, Sargassum patens, C. agardh*, and the like; a fungal cell (e.g., a yeast cell); an animal cell, tissue, or organ; a cell, tissue, or organ from an invertebrate animal (e.g. fruit fly, cnidarian, echinoderm, nematode, an insect, an arachnid, etc.); a cell, tissue, fluid, or organ from a vertebrate animal (e.g., fish, amphibian, reptile, bird, mammal); a cell, tissue, fluid, or organ from a mammal (e.g., a human; a non-human primate; an ungulate; a feline; a bovine; an ovine; a caprine; etc.). Suitable sample sources include nematodes, protozoans, and the like. Suitable sample sources include parasites such as helminths, malarial parasites, etc.

Suitable sample sources include a cell, tissue, or organism of any of the six kingdoms, e.g., Bacteria (e.g., Eubacteria); Archaebacteria; Protista; Fungi; Plantae; and Animalia. Suitable sample sources include plant-like members of the kingdom Protista, including, but not limited to, algae (e.g., green algae, red algae, glaucophytes, cyanobacteria); fungus-like members of Protista, e.g., slime molds, water molds, etc.; animal-like members of Protista, e.g., *flagellates* (e.g., *Euglena*), amoeboids (e.g., amoeba), sporozoans (e.g., Apicomplexa, Myxozoa, Microsporidia), and ciliates (e.g., Paramecium). Suitable sample sources include include members of the kingdom Fungi, including, but not limited to, members of any of the phyla: Basidiomycota (club fungi; e.g., members of *Agaricus, Amanita, Boletus*, Cantherellus, etc.); Ascomycota (sac fungi, including, e.g., *Saccharomyces*); Mycophycophyta (lichens); Zygomycota (conjugation fungi); and Deuteromycota. Suitable sample sources include include members of the kingdom Plantae, including, but not limited to, members of any of the following divisions: Bryophyta (e.g., mosses), Anthocerotophyta (e.g., hornworts), Hepaticophyta (e.g., liverworts), Lycophyta (e.g., club mosses), Sphenophyta (e.g., horsetails), Psilophyta (e.g., whisk ferns), Ophioglossophyta, Pterophyta (e.g., ferns), Cycadophyta, Gingkophyta, Pinophyta, Gnetophyta, and Magnoliophyta (e.g., flowering plants). Suitable sample sources include include members of the kingdom Animalia, including, but not limited to, members of any of the following phyla: Porifera (sponges); Placozoa; Orthonectida (parasites of marine invertebrates); Rhombozoa; Cnidaria (corals, anemones, jellyfish, sea pens, sea pansies, sea wasps); Ctenophora (comb jellies); Platyhelminthes (flatworms); Nemertina (ribbon worms); Ngathostomulida (jawed worms)p Gastrotricha; Rotifera; Priapulida; Kinorhyncha; Loricifera; Acanthocephala; Entoprocta; Nemotoda; Nematomorpha; Cycliophora; Mollusca (mollusks); Sipuncula (peanut worms); Annelida (segmented worms); Tardigrada (water bears); Onychophora (velvet worms); Arthropoda (including the subphyla: Chelicerata, Myriapoda, Hexapoda, and Crustacea, where the Chelicerata include, e.g., arachnids, Merostomata, and Pycnogonida, where the Myriapoda include, e.g., Chilopoda (centipedes), Diplopoda (millipedes), Paropoda, and Symphyla, where the Hexapoda include insects, and where the Crustacea include shrimp, krill, barnacles, etc.; Phoronida; Ectoprocta (moss animals); Brachiopoda; Echinodermata (e.g. starfish, sea daisies, feather stars, sea urchins, sea cucumbers, brittle stars, brittle baskets, etc.); Chaetognatha (arrow worms); Hemichordata (acorn worms); and Chordata. Suitable members of Chordata include any member of the following subphyla: Urochordata (sea squirts; including Ascidiacea, Thaliacea, and Larvacea); Cephalochordata (lancelets); Myxini (hagfish); and Vertebrata, where members of Vertebrata include, e.g., members of Petromyzontida (lampreys), Chondrichthyces (cartilaginous fish), Actinopterygii (ray-finned fish), Actinista (coelocanths), Dipnoi (lungfish), Reptilia (reptiles, e.g., snakes, alligators, crocodiles, lizards, etc.), Ayes (birds); and Mammalian (mammals) Suitable plants include any monocotyledon and any dicotyledon.

Suitable sources of a sample include cells, fluid, tissue, or organ taken from an organism; from a particular cell or group of cells isolated from an organism; etc. For example, where the organism is a plant, suitable sources include xylem, the phloem, the cambium layer, leaves, roots, etc. Where the organism is an animal, suitable sources include particular tissues (e.g., lung, liver, heart, kidney, brain, spleen, skin, fetal tissue, etc.), or a particular cell type (e.g., neuronal cells, epithelial cells, endothelial cells, astrocytes, macrophages, glial cells, islet cells, T lymphocytes, B lymphocytes, etc.).

In some cases, the source of the sample is a (or is suspected of being a diseased cell, fluid, tissue, or organ. In some cases, the source of the sample is a normal (non-diseased) cell, fluid, tissue, or organ. In some cases, the source of the sample is a (or is suspected of being a pathogen-infected cell, tissue, or organ. For example, the source of a sample can be an individual who may or may not be infected—and the sample could be any biological sample (e.g., blood, saliva, biopsy, plasma, serum, bronchoalveolar lavage, sputum, a fecal sample, cerebrospinal fluid, a fine needle aspirate, a swab sample (e.g., a buccal swab, a cervical swab, a nasal swab), interstitial fluid, synovial fluid, nasal discharge, tears, buffy coat, a mucous membrane sample, an epithelial cell sample (e.g., epithelial cell scraping), etc.) collected from the individual. In some cases, the sample is a cell-free liquid sample. In some cases, the sample is a liquid sample that can comprise cells. Pathogens include viruses, fungi, helminths, protozoa, malarial parasites, *Plasmodium* parasites, *Toxoplasma* parasites, *Schistosoma* parasites, and the like. "Helminths" include roundworms, heartworms, and phytophagous nematodes (Nematoda), flukes (Tematoda), Acanthocephala, and tapeworms (Cestoda). Protozoan infections include infections from Giardia spp., *Trichomonas* spp., African trypanosomiasis, amoebic dysentery, babesiosis, balantidial dysentery, Chaga's disease, coccidiosis, malaria and toxoplasmosis. Examples of pathogens such as parasitic/protozoan pathogens include, but are not limited to: *Plasmodium falciparum, Plasmodium vivax, Trypanosoma cruzi* and *Toxoplasma gondii*. Fungal pathogens include, but are not limited to: *Cryptococcus neoformans, Histoplasma capsulatum, Coccidioides immitis, Blastomyces dermatitidis, Chlamydia trachomatis*, and *Candida albicans*. Pathogenic viruses include, e.g., immunodeficiency virus (e.g., HIV); influenza virus; dengue; West Nile virus; herpes virus; yellow fever virus; Hepatitis Virus C; Hepatitis Virus A; Hepatitis Virus B; papillomavirus; and the like. Pathogenic viruses can include DNA viruses such as: a papovavirus (e.g., human papillomavirus (HPV), polyomavirus); a hepadnavirus (e.g., Hepatitis B Virus (HBV)); a herpesvirus (e.g., herpes simplex virus (HSV), varicella zoster virus (VZV), epstein-barr virus (EBV), cytomegalovirus (CMV), herpes lymphotropic virus, *Pityriasis Rosea*, kaposi's sarcoma-associated herpesvirus); an adenovirus (e.g., atadenovirus, aviadenovirus, ichtadenovirus, mastadenovirus, siadenovirus); a poxvirus (e.g., smallpox, vaccinia virus, cowpox virus, monkeypox virus, orf virus, pseudocowpox, bovine papular stomatitis virus; tanapox virus, yaba monkey tumor virus; molluscum contagiosum virus (MCV)); a parvovirus (e.g., adeno-associated virus (AAV), Parvovirus B19, human bocavirus, bufavirus, human parv4 G1); Geminiviridae; Nanoviridae; Phycodnaviridae; and the like. Pathogens can include, e.g., DNA viruses [e.g.: a papovavirus (e.g., human papillomavirus (HPV), polyomavirus); a hepadnavirus (e.g., Hepatitis B Virus (HBV)); a herpesvirus (e.g., herpes simplex virus (HSV), varicella zoster virus (VZV), Epstein-ban virus (EBV), cytomegalovirus (CMV), herpes lymphotropic virus, *Pityriasis Rosea*, kaposi's sarcoma-associated herpesvirus); an adenovirus (e.g., atadenovirus, aviadenovirus, ichtadenovirus, mastadenovirus, siadenovirus); a poxvirus (e.g., smallpox, vaccinia virus, cowpox virus, monkeypox virus, orf virus, pseudocowpox, bovine papular stomatitis virus; tanapox virus, yaba monkey tumor virus; molluscum contagiosum virus (MCV)); a parvovirus (e.g., adeno-associated virus (AAV), Parvovirus B19, human bocavirus, bufavirus, human parv4 G1); Geminiviridae; Nanoviridae; Phycodnaviridae; and the like], *Mycobacterium tuberculosis, Streptococcus agalactiae*, methicillin-resistant *Staphylococcus aureus, Legionella pneumophila, Streptococcus pyogenes, Escherichia coli, Neisseria gonorrhoeae, Neisseria meningitidis*, Pneumococcus, *Cryptococcus neoformans, Histoplasma capsulatum, Hemophilus influenzae* B, *Treponema pallidum*, Lyme disease spirochetes, *Pseudomonas aeruginosa, Mycobacterium leprae, Brucella abortus*, rabies virus, influenza virus, cytomegalovirus, herpes simplex virus I, herpes simplex virus II, human serum parvo-like virus, respiratory syncytial virus, varicella-zoster virus, hepatitis B virus, hepatitis C virus, measles virus, adenovirus, human T-cell leukemia viruses, Epstein-Barr virus, murine leukemia virus, mumps virus, vesicular stomatitis virus, Sindbis virus, lymphocytic choriomeningitis virus, wart virus, blue tongue virus, Sendai virus, feline leukemia virus, Reovirus, polio virus, simian virus 40, mouse mammary tumor virus, dengue virus, rubella virus, West Nile virus, *Plasmodium falciparum, Plasmodium vivax, Toxo-*

*plasma gondii, Trypanosoma rangeli, Trypanosoma cruzi, Trypanosoma rhodesiense, Trypanosoma brucei, Schistosoma mansoni, Schistosoma japonicum, Babesia bovis, Eimeria tenella, Onchocerca volvulus, Leishmania tropica, Mycobacterium tuberculosis, Trichinella spiralis, Theileria parva, Taenia hydatigena, Taenia ovis, Taenia saginata, Echinococcus granulosus, Mesocestoides corti, Mycoplasma arthritidis, M. hyorhinis, M. orale, M. arginini, Acholeplasma laidlawii, M. salivarium* and *M. pneumoniae.*

Measuring a Detectable Signal

In some cases, a subject method includes a step of measuring (e.g., measuring a detectable signal produced by CasZ-mediated ssDNA cleavage). Because a CasZ polypeptide cleaves non-targeted ssDNA once activated, which occurs when a guide RNA hybridizes with a target DNA in the presence of a CasZ polypeptide (and, in some cases, also including a tranc RNA), a detectable signal can be any signal that is produced when ssDNA is cleaved. In some cases, a subject method includes a step of measuring (e.g., measuring a detectable signal produced by CasY-mediated ssDNA cleavage). Because a CasY polypeptide cleaves non-targeted ssDNA once activated, which occurs when a guide RNA hybridizes with a target DNA in the presence of a CasY polypeptide (and, in some cases, also including a tranc RNA), a detectable signal can be any signal that is produced when ssDNA is cleaved.

For example, in some cases, the step of measuring can include one or more of: gold nanoparticle based detection (e.g., see Xu et al., Angew Chem Int Ed Engl. 2007; 46(19):3468-70; and Xia et al., Proc Natl Acad Sci USA. 2010 Jun. 15; 107(24):10837-41), fluorescence polarization, colloid phase transition/dispersion (e.g., Baksh et al., Nature. 2004 Jan. 8; 427(6970):139-41), electrochemical detection, semiconductor-based sensing (e.g., Rothberg et al., Nature. 2011 Jul. 20; 475(7356):348-52; e.g., one could use a phosphatase to generate a pH change after ssDNA cleavage reactions, by opening 2'-3' cyclic phosphates, and by releasing inorganic phosphate into solution), and detection of a labeled detector ssDNA (see elsewhere herein for more details). The readout of such detection methods can be any convenient readout. Examples of possible readouts include but are not limited to: a measured amount of detectable fluorescent signal; a visual analysis of bands on a gel (e.g., bands that represent cleaved product versus uncleaved substrate), a visual or sensor based detection of the presence or absence of a color (i.e., color detection method), and the presence or absence of (or a particular amount of) an electrical signal.

The measuring can in some cases be quantitative, e.g., in the sense that the amount of signal detected can be used to determine the amount of target DNA present in the sample. The measuring can in some cases be qualitative, e.g., in the sense that the presence or absence of detectable signal can indicate the presence or absence of targeted DNA (e.g., virus, SNP, etc.). In some cases, a detectable signal will not be present (e.g., above a given threshold level) unless the targeted DNA(s) (e.g., virus, SNP, etc.) is present above a particular threshold concentration. In some cases, the threshold of detection can be titrated by modifying the amount of CasZ polypeptide, guide RNA, sample volume, and/or detector ssDNA (if one is used). As such, for example, as would be understood by one of ordinary skill in the art, a number of controls can be used if desired in order to set up one or more reactions, each set up to detect a different threshold level of target DNA, and thus such a series of reactions could be used to determine the amount of target DNA present in a sample (e.g., one could use such a series of reactions to determine that a target DNA is present in the sample 'at a concentration of at least X'). Non-limiting examples of applications of/uses for the compositions and methods of the disclosure include single-nucleotide polymorphism (SNP) detection, cancer screening, detection of bacterial infection, detection of antibiotic resistance, detection of viral infection, and the like. The compositions and methods of this disclosure can be used to detect any DNA target. For example, any virus that integrates nucleic acid material into the genome can be detected because a subject sample can include cellular genomic DNA—and the guide RNA can be designed to detect integrated nucleotide sequence. A method of the present disclosure in some cases does not include an amplification step. A method of the present disclosure in some cases includes an amplification step.

In some cases, a method of the present disclosure can be used to determine the amount of a target DNA in a sample (e.g., a sample comprising the target DNA and a plurality of non-target DNAs). Determining the amount of a target DNA in a sample can comprise comparing the amount of detectable signal generated from a test sample to the amount of detectable signal generated from a reference sample. Determining the amount of a target DNA in a sample can comprise: measuring the detectable signal to generate a test measurement; measuring a detectable signal produced by a reference sample to generate a reference measurement; and comparing the test measurement to the reference measurement to determine an amount of target DNA present in the sample.

For example, in some cases, a method of the present disclosure for determining the amount of a target DNA in a sample comprises: a) contacting the sample (e.g., a sample comprising the target DNA and a plurality of non-target DNAs) with: (i) a guide RNA that hybridizes with the target DNA, (ii) a CasZ polypeptide that cleaves DNAs present in the sample, and (iii) a detector ssDNA; b) measuring a detectable signal produced by CasZ polypeptide-mediated ssDNA cleavage (e.g., cleavage of the detector ssDNA), generating a test measurement; c) measuring a detectable signal produced by a reference sample to generate a reference measurement; and d) comparing the test measurement to the reference measurement to determine an amount of target DNA present in the sample.

As another example, in some cases, a method of the present disclosure for determining the amount of a target DNA in a sample comprises: a) contacting the sample (e.g., a sample comprising the target DNA and a plurality of non-target DNAs) with: (i) a guide RNA that hybridizes with the target DNA, (ii) a CasZ polypeptide that cleaves DNAs present in the sample, (iii) a tranc RNA; (iv) a detector ssDNA; b) measuring a detectable signal produced by CasZ polypeptide-mediated ssDNA cleavage (e.g., cleavage of the detector ssDNA), generating a test measurement; c) measuring a detectable signal produced by a reference sample to generate a reference measurement; and d) comparing the test measurement to the reference measurement to determine an amount of target DNA present in the sample.

As another example, in some cases, a method of the present disclosure for determining the amount of a target DNA in a sample comprises: a) contacting the sample (e.g., a sample comprising the target DNA and a plurality of non-target DNAs) with: (i) a guide RNA that hybridizes with the target DNA, (ii) a CasY polypeptide that cleaves DNAs present in the sample, (iii) a tranc RNA; (iv) a detector ssDNA; b) measuring a detectable signal produced by CasY polypeptide-mediated ssDNA cleavage (e.g., cleavage of the detector ssDNA), generating a test measurement; c) measuring a detectable signal produced by a reference sample to generate a reference measurement; and d) comparing the test measurement to the reference measurement to determine an amount of target DNA present in the sample.

Amplification of Nucleic Acids in the Sample

In some embodiments, sensitivity of a subject composition and/or method (e.g., for detecting the presence of a target DNA, such as viral DNA or a SNP, in cellular genomic DNA) can be increased by coupling detection with nucleic acid amplification. In some cases, the nucleic acids in a sample are amplified prior to contact with a CasZ polypeptide or a CasY polypeptide that cleaves ssDNA (e.g., amplification of nucleic acids in the sample can begin prior to contact with a CasZ polypeptide or a CasY polypeptide). In some cases, the nucleic acids in a sample are amplified simultaneous with contact with a CasZ polypeptide. For example, in some cases a subject method includes amplifying nucleic acids of a sample (e.g., by contacting the sample with amplification components) prior to contacting the amplified sample with a CasZ polypeptide or a CasY polypeptide. In some cases, a subject method includes contacting a sample with amplification components at the same time (simultaneous with) that the sample is contacted with a CasZ polypeptide or a CasY polypeptide. If all components are added simultaneously (amplification components and detection components such as a CasZ polypeptide or a CasY polypeptide, a guide RNA, and a detector DNA), it is possible that the trans-cleavage activity of the CasZ polypeptide or the CasY polypeptide, will begin to degrade the nucleic acids of the sample at the same time the nucleic acids are undergoing amplification. However, even if this is the case, amplifying and detecting simultaneously can still increase sensitivity compared to performing the method without amplification.

In some cases, specific sequences (e.g., sequences of a virus, sequences that include a SNP of interest) are amplified from the sample, e.g., using primers. As such, a sequence to which the guide RNA will hybridize can be amplified in order to increase sensitivity of a subject detection method— this could achieve biased amplification of a desired sequence in order to increase the number of copies of the sequence of interest present in the sample relative to other sequences present in the sample. As one illustrative example, if a subject method is being used to determine whether a given sample includes a particular virus (or a particular SNP), a desired region of viral sequence (or non-viral genomic sequence) can be amplified, and the region amplified will include the sequence that would hybridize to the guide RNA if the viral sequence (or SNP) were in fact present in the sample.

As noted, in some cases the nucleic acids are amplified (e.g., by contact with amplification components) prior to contacting the amplified nucleic acids with a CasZ polypeptide or a CasY polypeptide. In some cases, amplification occurs for 10 seconds or more, (e.g., 30 seconds or more, 45 seconds or more, 1 minute or more, 2 minutes or more, 3 minutes or more, 4 minutes or more, 5 minutes or more, 7.5 minutes or more, 10 minutes or more, etc.) prior to contact with an enzymatically active CasZ polypeptide or enzymatically active CasY polypeptide. In some cases, amplification occurs for 2 minutes or more (e.g., 3 minutes or more, 4 minutes or more, 5 minutes or more, 7.5 minutes or more, 10 minutes or more, etc.) prior to contact with an active CasZ polypeptide or an active CasY polypeptide. In some cases, amplification occurs for a period of time in a range of from 10 seconds to 60 minutes (e.g., 10 seconds to 40 minutes, 10 seconds to 30 minutes, 10 seconds to 20 minutes, 10 seconds to 15 minutes, 10 seconds to 10 minutes, 10 seconds to 5 minutes, 30 seconds to 40 minutes, 30 seconds to 30 minutes, 30 seconds to 20 minutes, 30 seconds to 15 minutes, 30 seconds to 10 minutes, 30 seconds to 5 minutes, 1 minute to 40 minutes, 1 minute to 30 minutes, 1 minute to 20 minutes, 1 minute to 15 minutes, 1 minute to 10 minutes, 1 minute to 5 minutes, 2 minutes to 40 minutes, 2 minutes to 30 minutes, 2 minutes to 20 minutes, 2 minutes to 15 minutes, 2 minutes to 10 minutes, 2 minutes to 5 minutes, 5 minutes to 40 minutes, 5 minutes to 30 minutes, 5 minutes to 20 minutes, 5 minutes to 15 minutes, or 5 minutes to 10 minutes). In some cases, amplification occurs for a period of time in a range of from 5 minutes to 15 minutes. In some cases, amplification occurs for a period of time in a range of from 7 minutes to 12 minutes.

In some cases, a sample is contacted with amplification components at the same time as contact with a CasZ polypeptide. In some such cases, the CasZ polypeptide is inactive at the time of contact and is activated once nucleic acids in the sample have been amplified. In some cases, a sample is contacted with amplification components at the same time as contact with a CasY polypeptide. In some such cases, the CasY polypeptide is inactive at the time of contact and is activated once nucleic acids in the sample have been amplified.

Various amplification methods and components will be known to one of ordinary skill in the art and any convenient method can be used (see, e.g., Zanoli and Spoto, Biosensors (Basel). 2013 March; 3(1): 18-43; Gill and Ghaemi, Nucleosides, Nucleotides, and Nucleic Acids, 2008, 27: 224-243; Craw and Balachandrana, Lab Chip, 2012, 12, 2469-2486; which are herein incorporated by reference in their entirety). Nucleic acid amplification can comprise polymerase chain reaction (PCR), reverse transcription PCR (RT-PCR), quantitative PCR (qPCR), reverse transcription qPCR (RT-qPCR), nested PCR, multiplex PCR, asymmetric PCR, touchdown PCR, random primer PCR, hemi-nested PCR, polymerase cycling assembly (PCA), colony PCR, ligase chain reaction (LCR), digital PCR, methylation specific-PCR (MSP), co-amplification at lower denaturation temperature-PCR (COLD-PCR), allele-specific PCR, intersequence-specific PCR (ISS-PCR), whole genome amplification (WGA), inverse PCR, and thermal asymmetric interlaced PCR (TAIL-PCR).

In some cases, the amplification is isothermal amplification. The term "isothermal amplification" indicates a method of nucleic acid (e.g., DNA) amplification (e.g., using enzymatic chain reaction) that can use a single temperature incubation thereby obviating the need for a thermal cycler. Isothermal amplification is a form of nucleic acid amplification which does not rely on the thermal denaturation of the target nucleic acid during the amplification reaction and hence may not require multiple rapid changes in temperature. Isothermal nucleic acid amplification methods can therefore be carried out inside or outside of a laboratory environment. By combining with a reverse transcription step, these amplification methods can be used to isothermally amplify RNA.

Examples of isothermal amplification methods include but are not limited to: loop-mediated isothermal Amplification (LAMP), helicase-dependent Amplification (HDA), recombinase polymerase amplification (RPA), strand displacement amplification (SDA), nucleic acid sequence-based amplification (NASBA), transcription mediated amplification (TMA), nicking enzyme amplification reaction (NEAR), rolling circle amplification (RCA), multiple displacement amplification (MDA), Ramification (RAM), circular helicase-dependent amplification (cHDA), single primer isothermal amplification (SPIA), signal mediated amplification of RNA technology (SMART), self-sustained sequence replication (3SR), genome exponential amplification reaction (GEAR) and isothermal multiple displacement amplification (IMDA).

In some cases, the amplification is recombinase polymerase amplification (RPA) (see, e.g., U.S. Pat. Nos. 8,030,000; 8,426,134; 8,945,845; 9,309,502; and 9,663,820, which are hereby incorporated by reference in their entirety). Recombinase polymerase amplification (RPA) uses two opposing primers (much like PCR) and employs three enzymes—a recombinase, a single-stranded DNA-binding protein (SSB) and a strand-displacing polymerase. The recombinase pairs oligonucleotide primers with homologous sequence in duplex DNA, SSB binds to displaced strands of DNA to prevent the primers from being displaced, and the strand displacing polymerase begins DNA synthesis where the primer has bound to the target DNA. Adding a reverse transcriptase enzyme to an RPA reaction can facilitate detection RNA as well as DNA, without the need for a separate step to produce cDNA. One example of components for an RPA reaction is as follows (see, e.g., U.S. Pat. Nos. 8,030,000; 8,426,134; 8,945,845; 9,309,502; 9,663,820): 50 mM Tris pH 8.4, 80 mM Potassium actetate, 10 mM Magnesium acetate, 2 mM DTT, 5% PEG compound (Carbowax-20M), 3 mM ATP, 30 mM Phosphocreatine, 100 ng/µl creatine kinase, 420 ng/µl gp32, 140 ng/µl UvsX, 35 ng/µl UvsY, 2000M dNTPs, 300 nM each oligonucleotide, 35 ng/µl Bsu polymerase, and a nucleic acid-containing sample).

In a transcription mediated amplification (TMA), an RNA polymerase is used to make RNA from a promoter engineered in the primer region, and then a reverse transcriptase synthesizes cDNA from the primer. A third enzyme, e.g., Rnase H can then be used to degrade the RNA target from cDNA without the heat-denatured step. This amplification technique is similar to Self-Sustained Sequence Replication (3SR) and Nucleic Acid Sequence Based Amplification (NASBA), but varies in the enzymes employed. For another example, helicase-dependent amplification (HDA) utilizes a thermostable helicase (Tte-UvrD) rather than heat to unwind dsDNA to create single-strands that are then available for hybridization and extension of primers by polymerase. For yet another example, a loop mediated amplification (LAMP) employs a thermostable polymerase with strand displacement capabilities and a set of four or more specific designed primers. Each primer is designed to have hairpin ends that, once displaced, snap into a hairpin to facilitate self-priming and further polymerase extension. In a LAMP reaction, though the reaction proceeds under isothermal conditions, an initial heat denaturation step is required for double-stranded targets. In addition, amplification yields a ladder pattern of various length products. For yet another example, a strand displacement amplification (SDA) combines the ability of a restriction endonuclease to nick the unmodified strand of its target DNA and an exonuclease-deficient DNA polymerase to extend the 3' end at the nick and displace the downstream DNA strand.

Detector DNA

In some cases, a subject method includes contacting a sample (e.g., a sample comprising a target DNA and a plurality of non-target ssDNAs) with: i) a CasZ polypeptide; ii) a guide RNA; and iii) a detector DNA that is single stranded and does not hybridize with the guide sequence of the guide RNA.

A suitable single-stranded detector DNA has a length of from 7 nucleotides to 25 nucleotides. For example, a suitable single-stranded detector DNA has a length of from 7 nucleotides to 10 nucleotides, from 11 nucleotides to 15 nucleotides, from 15 nucleotides to 20 nucleotides, or from 20 nucleotides to 25 nucleotides. In some cases, a suitable single-stranded detector DNA has a length of from 10 nucleotides to 15 nucleotides. In some cases, a suitable single-stranded detector DNA has a length of 10 nucleotides. In some cases, a suitable single-stranded detector DNA has a length of 11 nucleotides. In some cases, a suitable single-stranded detector DNA has a length of 12 nucleotides. In some cases, a suitable single-stranded detector DNA has a length of 13 nucleotides. In some cases, a suitable single-stranded detector DNA has a length of 14 nucleotides. In some cases, a suitable single-stranded detector DNA has a length of 15 nucleotides.

In some cases, a subject method includes: a) contacting a sample with a labeled single stranded detector DNA (detector ssDNA) that includes a fluorescence-emitting dye pair; a CasZ polypeptide that cleaves the labeled detector ssDNA after it is activated (by binding to the guide RNA in the context of the guide RNA hybridizing to a target DNA); and b) measuring the detectable signal that is produced by the fluorescence-emitting dye pair. For example, in some cases, a subject method includes contacting a sample with a labeled detector ssDNA comprising a fluorescence resonance energy transfer (FRET) pair or a quencher/fluor pair, or both. In some cases, a subject method includes contacting a sample with a labeled detector ssDNA comprising a FRET pair. In some cases, a subject method includes contacting a sample with a labeled detector ssDNA comprising a fluor/quencher pair.

Fluorescence-emitting dye pairs comprise a FRET pair or a quencher/fluor pair. In both cases of a FRET pair and a quencher/fluor pair, the emission spectrum of one of the dyes overlaps a region of the absorption spectrum of the other dye in the pair. As used herein, the term "fluorescence-emitting dye pair" is a generic term used to encompass both a "fluorescence resonance energy transfer (FRET) pair" and a "quencher/fluor pair," both of which terms are discussed in more detail below. The term "fluorescence-emitting dye pair" is used interchangeably with the phrase "a FRET pair and/or a quencher/fluor pair."

In some cases (e.g., when the detector ssDNA includes a FRET pair) the labeled detector ssDNA produces an amount of detectable signal prior to being cleaved, and the amount of detectable signal that is measured is reduced when the labeled detector ssDNA is cleaved. In some cases, the labeled detector ssDNA produces a first detectable signal prior to being cleaved (e.g., from a FRET pair) and a second detectable signal when the labeled detector ssDNA is cleaved (e.g., from a quencher/fluor pair). As such, in some cases, the labeled detector ssDNA comprises a FRET pair and a quencher/fluor pair.

In some cases, the labeled detector ssDNA comprises a FRET pair. FRET is a process by which radiationless transfer of energy occurs from an excited state fluorophore to a second chromophore in close proximity. The range over which the energy transfer can take place is limited to approximately 10 nanometers (100 angstroms), and the efficiency of transfer is extremely sensitive to the separation distance between fluorophores. Thus, as used herein, the term "FRET" ("fluorescence resonance energy transfer"; also known as "Forster resonance energy transfer") refers to a physical phenomenon involving a donor fluorophore and a matching acceptor fluorophore selected so that the emission spectrum of the donor overlaps the excitation spectrum of the acceptor, and further selected so that when donor and acceptor are in close proximity (usually 10 nm or less) to one another, excitation of the donor will cause excitation of and emission from the acceptor, as some of the energy passes from donor to acceptor via a quantum coupling effect. Thus, a FRET signal serves as a proximity gauge of the donor and acceptor; only when they are in close proximity to one another is a signal generated. The FRET donor moiety (e.g., donor fluorophore) and FRET acceptor moiety (e.g., acceptor fluorophore) are collectively referred to herein as a "FRET pair".

The donor-acceptor pair (a FRET donor moiety and a FRET acceptor moiety) is referred to herein as a "FRET pair" or a "signal FRET pair." Thus, in some cases, a subject labeled detector ssDNA includes two signal partners (a signal pair), when one signal partner is a FRET donor moiety and the other signal partner is a FRET acceptor moiety. A subject labeled detector ssDNA that includes such a FRET pair (a FRET donor moiety and a FRET acceptor moiety) will thus exhibit a detectable signal (a FRET signal) when the signal partners are in close proximity (e.g., while on the same RNA molecule), but the signal will be reduced (or absent) when the partners are separated (e.g., after cleavage of the RNA molecule by a CasZ polypeptide).

FRET donor and acceptor moieties (FRET pairs) will be known to one of ordinary skill in the art and any convenient FRET pair (e.g., any convenient donor and acceptor moiety pair) can be used. Examples of suitable FRET pairs include but are not limited to those presented in Table 1. See also: B ajar et al. Sensors (Basel). 2016 Sep. 14; 16(9); and Abraham et al. PLoS One. 2015 Aug. 3; 10(8):e0134436.

TABLE 8

Examples of FRET pairs (donor and acceptor FRET moieties)

| Donor | Acceptor |
| --- | --- |
| Tryptophan | Dansyl |
| IAEDANS (1) | DDPM (2) |
| BFP | DsRFP |
| Dansyl | Fluorescein isothiocyanate (FITC) |
| Dansyl | Octadecylrhodamine |
| Cyan fluorescent protein (CFP) | Green fluorescent protein (GFP) |
| CF (3) | Texas Red |
| Fluorescein | Tetramethylrhodamine |
| Cy3 | Cy5 |
| GFP | Yellow fluorescent protein (YFP) |
| BODIPY FL (4) | BODIPY FL (4) |
| Rhodamine 110 | Cy3 |
| Rhodamine 6G | Malachite Green |
| FITC | Eosin Thiosemicarbazide |
| B-Phycoerythrin | Cy5 |
| Cy5 | Cy5.5 |

(1) 5-(2-iodoacetylaminoethyl)aminonaphthalene-1-sulfonic acid
(2) N-(4-dimethylamino-3,5-dinitrophenyl)maleimide
(3) carboxyfluorescein succinimidyl ester
(4) 4,4-difluoro-4-bora-3a,4a-diaza-s-indacene In some cases, a detectable signal is produced when the labeled detector ssDNA is cleaved (e.g., in some cases, the labeled detector ssDNA comprises a quencher/fluor pair). One signal partner of a signal quenching pair produces a detectable signal and the other signal partner is a quencher moiety that quenches the detectable signal of the first signal partner (i.e., the quencher moiety quenches the signal of the signal moiety such that the signal from the signal moiety is reduced (quenched) when the signal partners are in proximity to one another, e.g., when the signal partners of the signal pair are in close proximity).

For example, in some cases, an amount of detectable signal increases when the labeled detector ssDNA is cleaved. For example, in some cases, the signal exhibited by one signal partner (a signal moiety) is quenched by the other signal partner (a quencher signal moiety), e.g., when both are present on the same ssDNA molecule prior to cleavage by a CasZ polypeptide. Such a signal pair is referred to herein as a "quencher/fluor pair", "quenching pair", or "signal quenching pair." For example, in some cases, one signal partner (e.g., the first signal partner) is a signal moiety that produces a detectable signal that is quenched by the second signal partner (e.g., a quencher moiety). The signal partners of such a quencher/fluor pair will thus produce a detectable signal when the partners are separated (e.g., after cleavage of the detector ssDNA by a CasZ polypeptide or a CasY polypeptide), but the signal will be quenched when the partners are in close proximity (e.g., prior to cleavage of the detector ssDNA by a CasZ polypeptide or a CasY polypeptide).

A quencher moiety can quench a signal from the signal moiety (e.g., prior to cleavage of the detector ssDNA by a CasZ polypeptide or a CasY polypeptide) to various degrees. In some cases, a quencher moiety quenches the signal from the signal moiety where the signal detected in the presence of the quencher moiety (when the signal partners are in proximity to one another) is 95% or less of the signal detected in the absence of the quencher moiety (when the signal partners are separated). For example, in some cases, the signal detected in the presence of the quencher moiety can be 90% or less, 80% or less, 70% or less, 60% or less, 50% or less, 40% or less, 30% or less, 20% or less, 15% or less, 10% or less, or 5% or less of the signal detected in the absence of the quencher moiety. In some cases, no signal (e.g., above background) is detected in the presence of the quencher moiety.

In some cases, the signal detected in the absence of the quencher moiety (when the signal partners are separated) is at least 1.2 fold greater (e.g., at least 1.3 fold, at least 1.5 fold, at least 1.7 fold, at least 2 fold, at least 2.5 fold, at least 3 fold, at least 3.5 fold, at least 4 fold, at least 5 fold, at least 7 fold, at least 10 fold, at least 20 fold, or at least 50 fold greater) than the signal detected in the presence of the quencher moiety (when the signal partners are in proximity to one another).

In some cases, the signal moiety is a fluorescent label. In some such cases, the quencher moiety quenches the signal (the light signal) from the fluorescent label (e.g., by absorbing energy in the emission spectra of the label). Thus, when the quencher moiety is not in proximity with the signal moiety, the emission (the signal) from the fluorescent label is detectable because the signal is not absorbed by the quencher moiety. Any convenient donor acceptor pair (signal moiety/quencher moiety pair) can be used and many suitable pairs are known in the art.

In some cases, the quencher moiety absorbs energy from the signal moiety (also referred to herein as a "detectable label") and then emits a signal (e.g., light at a different wavelength). Thus, in some cases, the quencher moiety is itself a signal moiety (e.g., a signal moiety can be 6-carboxyfluorescein while the quencher moiety can be 6-carboxy-tetramethylrhodamine), and in some such cases, the pair could also be a FRET pair. In some cases, a quencher moiety is a dark quencher. A dark quencher can absorb excitation energy and dissipate the energy in a different way (e.g., as heat). Thus, a dark quencher has minimal to no fluorescence of its own (does not emit fluorescence). Examples of dark quenchers are further described in U.S. Pat. Nos. 8,822,673 and 8,586,718; U.S. patent publications 20140378330, 20140349295, and 20140194611; and international patent applications: WO200142505 and WO200186001, all if which are hereby incorporated by reference in their entirety.

Examples of fluorescent labels include, but are not limited to: an Alexa Fluor® dye, an ATTO dye (e.g., ATTO 390, ATTO 425, ATTO 465, ATTO 488, ATTO 495, ATTO 514. ATTO 520, ATTO 532, ATTO Rho6G, ATTO 542, ATTO 550, ATTO 565, ATTO Rho3B, ATTO Rho11, ATTO Rho12, ATTO Thio12, ATTO Rho101, ATTO 590, ATTO 594, ATTO Rho13, ATTO 610, ATTO 620, ATTO Rho14, ATTO 633, ATTO 647, ATTO 647N, ATTO 655, ATTO Oxa12, ATTO 665, ATTO 680, ATTO 700, ATTO 725, ATTO 740), a DyLight dye, a cyanine dye (e.g., Cy2, Cy3, Cy3.5, Cy3b, Cy5, Cy5.5, Cy7, Cy7.5), a FluoProbes dye, a Sulfo Cy dye, a Seta dye, an IRIS Dye, a SeTau dye, an SRfluor dye, a Square dye, fluorescein isothiocyanate (FITC), tetramethylrhodamine (TRITC), Texas Red, Oregon Green, Pacific Blue, Pacific Green, Pacific Orange, quantum dots, and a tethered fluorescent protein.

In some cases, a detectable label is a fluorescent label selected from: an Alexa Fluor® dye, an ATTO dye (e.g., ATTO 390, ATTO 425, ATTO 465, ATTO 488, ATTO 495, ATTO 514, ATTO 520, ATTO 532, ATTO Rho6G, ATTO 542, ATTO 550. ATTO 565, ATTO Rho3B, ATTO Rho11, ATTO Rho12, ATTO Thio12, ATTO Rho101, ATTO 590, ATTO 594, ATTO Rho13, ATTO 610, ATTO 620, ATTO Rho14, ATTO 633, ATTO 647, ATTO 647N, ATTO 655, ATTO Oxa12, ATTO 665, ATTO 680, ATTO 700, ATTO 725, ATTO 740), a DyLight dye, a cyanine dye (e.g., Cy2, Cy3, Cy3.5, Cy3b, Cy5, Cy5.5, Cy7, Cy7.5), a FluoProbes dye, a Sulfo Cy dye, a Seta dye, an IRIS Dye, a SeTau dye, an SRfluor dye, a Square dye, fluorescein (FITC), tetramethylrhodamine (TRITC), Texas Red, Oregon Green, Pacific Blue, Pacific Green, and Pacific Orange.

In some cases, a detectable label is a fluorescent label selected from: an Alexa Fluor® dye, an ATTO dye (e.g., ATTO 390, ATTO 425, ATTO 465, ATTO 488, ATTO 495, ATTO 514, ATTO 520, ATTO 532, ATTO Rho6G, ATTO 542, ATTO 550. ATTO 565, ATTO Rho3B, ATTO Rho11, ATTO Rho12, ATTO Thio12, ATTO Rho101, ATTO 590, ATTO 594, ATTO Rho13, ATTO 610, ATTO 620, ATTO Rho14, ATTO 633, ATTO 647, ATTO 647N, ATTO 655, ATTO Oxa12, ATTO 665, ATTO 680, ATTO 700, ATTO 725, ATTO 740), a DyLight dye, a cyanine dye (e.g., Cy2, Cy3, Cy3.5, Cy3b, Cy5, Cy5.5, Cy7, Cy7.5), a FluoProbes dye, a Sulfo Cy dye, a Seta dye, an IRIS Dye, a SeTau dye, an SRfluor dye, a Square dye, fluorescein (FITC), tetramethylrhodamine (TRITC), Texas Red, Oregon Green, Pacific Blue, Pacific Green, Pacific Orange, a quantum dot, and a tethered fluorescent protein.

Examples of ATTO dyes include, but are not limited to: ATTO 390, ATTO 425, ATTO 465, ATTO 488, ATTO 495, ATTO 514. ATTO 520, ATTO 532, ATTO Rho6G, ATTO 542, ATTO 550, ATTO 565, ATTO Rho3B, ATTO Rho11, ATTO Rho12, ATTO Thio12, ATTO Rho101, ATTO 590, ATTO 594, ATTO Rho13, ATTO 610, ATTO 620, ATTO Rho14, ATTO 633, ATTO 647. ATTO 647N, ATTO 655, ATTO Oxa12, ATTO 665, ATTO 680, ATTO 700, ATTO 725, and ATTO 740.

Examples of AlexaFluor dyes include, but are not limited to: Alexa Fluor® 350, Alexa Fluor® 405, Alexa Fluor® 430, Alexa Fluor® 488, Alexa Fluor® 500, Alexa Fluor® 514, Alexa Fluor® 532, Alexa Fluor® 546, Alexa Fluor® 555, Alexa Fluor® 568, Alexa Fluor® 594, Alexa Fluor® 610, Alexa Fluor® 633, Alexa Fluor® 635, Alexa Fluor® 647, Alexa Fluor® 660. Alexa Fluor® 680, Alexa Fluor® 700, Alexa Fluor® 750, Alexa Fluor® 790, and the like.

Examples of quencher moieties include, but are not limited to: a dark quencher, a Black Hole Quencher® (BHQ®) (e.g., BHQ-0, BHQ-1, BHQ-2, BHQ-3), a Qxl quencher, an ATTO quencher (e.g., ATTO 540Q, ATTO 580Q, and ATTO 612Q), dimethylaminoazobenzenesulfonic acid (Dabsyl), Iowa Black RQ, Iowa Black FQ, IRDye QC-1, a QSY dye (e.g., QSY 7, QSY 9, QSY 21), AbsoluteQuencher, Eclipse, and metal clusters such as gold nanoparticles, and the like.

In some cases, a quencher moiety is selected from: a dark quencher, a Black Hole Quencher® (BHQ®) (e.g., BHQ-0, BHQ-1, BHQ-2, BHQ-3), a Qxl quencher, an ATTO quencher (e.g., ATTO 540Q, ATTO 580Q, and ATTO 612Q), dimethylaminoazobenzenesulfonic acid (Dabsyl), Iowa Black RQ, Iowa Black FQ, IRDye QC-1, a QSY dye (e.g., QSY 7, QSY 9, QSY 21), AbsoluteQuencher, Eclipse, and a metal cluster.

Examples of an ATTO quencher include, but are not limited to: ATTO 540Q, ATTO 580Q, and ATTO 612Q. Examples of a Black Hole Quencher® (BHQ®) include, but are not limited to: BHQ-0 (493 mm), BHQ-1 (534 nm), BHQ-2 (579 nm) and BHQ-3 (672 mm).

For examples of some detectable labels (e.g., fluorescent dyes) and/or quencher moieties, see, e.g., Bao et al., Annu Rev Biomed Eng. 2009; 11:25-47; as well as U.S. Pat. Nos. 8,822,673 and 8,586,718; U.S. patent publications 20140378330, 20140349295, 20140194611, 20130323851, 20130224871, 20110223677, 20110190486, 20110172420, 20060179585 and 20030003486; and international patent applications: WO200142505 and WO200186001, all of which are hereby incorporated by reference in their entirety.

In some cases, cleavage of a labeled detector ssDNA can be detected by measuring a colorimetric read-out. For example, the liberation of a fluorophore (e.g., liberation from a FRET pair, liberation from a quencher/fluor pair, and the like) can result in a wavelength shift (and thus color shift) of a detectable signal. Thus, in some cases, cleavage of a subject labeled detector ssDNA can be detected by a color-shift. Such a shift can be expressed as a loss of an amount of signal of one color (wavelength), a gain in the amount of another color, a change in the ration of one color to another, and the like.

Kits for Detecting Target DNA

The present disclosure provides a kit for detecting a target DNA, e.g., in a sample comprising a plurality of DNAs. In some cases, the kit comprises: (a) a labeled detector ssDNA (e.g., a labeled detector ssDNA comprising a fluorescence-emitting dye pair, e.g., a FRET pair and/or a quencher/fluor pair); and (b) one or more of: (i) a guide RNA, and/or a nucleic acid encoding said guide RNA; and ii) a CasZ polypeptide, and/or a nucleic acid encoding said CasZ polypeptide. In some cases, a nucleic acid encoding a guide RNA includes sequence insertion sites for the insertion of guide sequences by a user.

In some cases, the kit comprises: (a) a labeled detector ssDNA (e.g., a labeled detector ssDNA comprising a fluorescence-emitting dye pair, e.g., a FRET pair and/or a quencher/fluor pair); and (b) one or more of: (i) a guide RNA, and/or a nucleic acid encoding said guide RNA; ii) a tranc RNA and/or a nucleic acid encoding said guide RNA; and iii) a CasZ polypeptide, and/or a nucleic acid encoding said CasZ polypeptide. In some cases, a nucleic acid encoding a guide RNA includes sequence insertion sites for the insertion of guide sequences by a user.

In some cases, the kit comprises: (a) a labeled detector ssDNA (e.g., a labeled detector ssDNA comprising a fluorescence-emitting dye pair, e.g., a FRET pair and/or a quencher/fluor pair); and (b) one or more of: (i) a single-molecule RNA comprising a guide RNA and a tranc RNA, and/or a nucleic acid encoding single-molecule RNA; and iii) a CasZ polypeptide, and/or a nucleic acid encoding said CasZ polypeptide. In some cases, a nucleic acid encoding a single-molecule RNA includes sequence insertion sites for the insertion of guide sequences by a user.

In some cases, a subject kit comprises: (a) a labeled detector ssDNA comprising a fluorescence-emitting dye pair, e.g., a FRET pair and/or a quencher/fluor pair; and (b) one or more of: (i) a guide RNA, and/or a nucleic acid encoding said guide RNA; and/or i) a CasZ polypeptide.

The present disclosure provides a kit for detecting a target DNA, e.g., in a sample comprising a plurality of DNAs. In some cases, the kit comprises: (a) a labeled detector ssDNA (e.g., a labeled detector ssDNA comprising a fluorescence-emitting dye pair, e.g., a FRET pair and/or a quencher/fluor pair); and (b) one or more of: (i) a guide RNA, and/or a nucleic acid encoding said guide RNA; and ii) a CasY polypeptide, and/or a nucleic acid encoding said CasY polypeptide. In some cases, a nucleic acid encoding a guide RNA includes sequence insertion sites for the insertion of guide sequences by a user.

In some cases, the kit comprises: (a) a labeled detector ssDNA (e.g., a labeled detector ssDNA comprising a fluorescence-emitting dye pair, e.g., a FRET pair and/or a quencher/fluor pair); and (b) one or more of: (i) a guide RNA, and/or a nucleic acid encoding said guide RNA; ii) a tranc RNA and/or a nucleic acid encoding said guide RNA; and iii) a CasY polypeptide, and/or a nucleic acid encoding said CasY polypeptide. In some cases, a nucleic acid encoding a guide RNA includes sequence insertion sites for the insertion of guide sequences by a user.

In some cases, the kit comprises: (a) a labeled detector ssDNA (e.g., a labeled detector ssDNA comprising a fluorescence-emitting dye pair, e.g., a FRET pair and/or a quencher/fluor pair); and (b) one or more of: (i) a single-molecule RNA comprising a guide RNA and a tranc RNA, and/or a nucleic acid encoding single-molecule RNA; and iii) a CasY polypeptide, and/or a nucleic acid encoding said CasY polypeptide. In some cases, a nucleic acid encoding a single-molecule RNA includes sequence insertion sites for the insertion of guide sequences by a user.

In some cases, a subject kit comprises: (a) a labeled detector ssDNA comprising a fluorescence-emitting dye pair, e.g., a FRET pair and/or a quencher/fluor pair; and (b) one or more of: (i) a guide RNA, and/or a nucleic acid encoding said guide RNA; and/or i) a CasY polypeptide.

Positive Controls

A kit of the present disclosure (e.g., one that comprises a labeled detector ssDNA and a CasZ polypeptide; or one that comprises a labeled detector ssDNA and a CasY polypeptide) can also include a positive control target DNA. In some cases, the kit also includes a positive control guide RNA that comprises a nucleotide sequence that hybridizes to the control target DNA. In some cases, the positive control target DNA is provided in various amounts, in separate containers. In some cases, the positive control target DNA is provided in various known concentrations, in separate containers, along with control non-target DNAs.

Nucleic Acids

While the RNAs of the disclosure (e.g., guide RNAs, tranc RNAs, single-molecule RNAs comprising a guide RNA and a tranc RNA) can be synthesized using any convenient method (e.g., chemical synthesis, in vitro using an RNA polymerase enzyme, e.g., T7 polymerase, T3 polymerase, SP6 polymerase, etc.), nucleic acids encoding such RNAs are also envisioned. Additionally, while a CasZ polypeptide of the disclosure can be provided (e.g., as part of a kit) in protein form, nucleic acids (such as mRNA and/or DNA) encoding the CasZ polypeptide can also be provided.

In some cases, a kit of the present disclosure comprises a nucleic acid (e.g., a DNA, e.g., a recombinant expression vector) that comprises a nucleotide sequence encoding a single-molecule RNA comprising: i) a guide RNA; and ii) a tranc RNA. In some cases, the nucleotide sequence encodes the guide RNA portion of the single-molecule RNA without a guide sequence. For example, in some cases, the nucleic acid comprises a nucleotide sequence encoding: i) a constant region of a guide RNA (a guide RNA without a guide sequence), and comprises an insertion site for a nucleic acid encoding a guide sequence; and ii) a tranc RNA.

For example, in some cases, a kit of the present disclosure comprises a nucleic acid (e.g., a DNA, e.g., a recombinant expression vector) that comprises a nucleotide sequence encoding a guide RNA. In some cases, the nucleotide sequence encodes a guide RNA without a guide sequence. For example, in some cases, the nucleic acid comprises a nucleotide sequence encoding a constant region of a guide RNA (a guide RNA without a guide sequence), and comprises an insertion site for a nucleic acid encoding a guide sequence. In some cases, a kit of the present disclosure comprises a nucleic acid (e.g., an mRNA, a DNA, e.g., a recombinant expression vector) that comprises a nucleotide sequence encoding a CasZ polypeptide. In some cases, a kit of the present disclosure comprises a nucleic acid (e.g., an mRNA, a DNA, e.g., a recombinant expression vector) that comprises a nucleotide sequence encoding a CasY polypeptide.

In some cases, the guide RNA-encoding nucleotide sequence is operably linked to a promoter, e.g., a promoter that is functional in a prokaryotic cell, a promoter that is functional in a eukaryotic cell, a promoter that is functional in a mammalian cell, a promoter that is functional in a human cell, and the like. In some cases, a nucleotide sequence encoding a CasZ polypeptide is operably linked to a promoter, e.g., a promoter that is functional in a prokaryotic cell, a promoter that is functional in a eukaryotic cell, a promoter that is functional in a mammalian cell, a promoter that is functional in a human cell, a cell type-specific promoter, a regulatable promoter, a tissue-specific promoter, and the like.

In some cases, the guide RNA-encoding nucleotide sequence is operably linked to a promoter, e.g., a promoter that is functional in a prokaryotic cell, a promoter that is functional in a eukaryotic cell, a promoter that is functional in a mammalian cell, a promoter that is functional in a human cell, and the like. In some cases, a nucleotide sequence encoding a CasY polypeptide is operably linked to a promoter, e.g., a promoter that is functional in a prokaryotic cell, a promoter that is functional in a eukaryotic cell, a promoter that is functional in a mammalian cell, a promoter that is functional in a human cell, a cell type-specific promoter, a regulatable promoter, a tissue-specific promoter, and the like.

Class 2 CRISPR/Cas Effector Protein Variants

A variant Class 2 CRISPR/Cas effector protein has an amino acid sequence that is different by at least one amino acid (e.g., has a deletion, insertion, substitution, fusion) when compared to the amino acid sequence of the corresponding wild type Class 2 CRISPR/Cas effector protein. A Class 2 CRISPR/Cas effector protein that cleaves one strand but not the other of a double stranded target nucleic acid is referred to herein as a "nickase" (e.g., a "nickase Class 2 CRISPR/Cas effector protein"). A Class 2 CRISPR/Cas effector protein that has substantially no nuclease activity is referred to herein as a dead Class 2 CRISPR/Cas effector protein ("dEffector") (with the caveat that nuclease activity can be provided by a heterologous polypeptide—a fusion partner—in the case of a chimeric effector protein, which is described in more detail below). For any of the variant proteins described herein (e.g., nickase, dEffector, chimeric effector), the variant can include a Class 2 CRISPR/Cas effector protein sequence with the same parameters described above (e.g., domains that are present, percent identity, length, and the like).

Variants—Catalytic Activity

In some cases, the Class 2 CRISPR/Cas effector protein is a variant Class 2 CRISPR/Cas effector protein, e.g., mutated relative to the naturally occurring catalytically active sequence, and exhibits reduced cleavage activity (e.g., exhibits 90%, or less, 80% or less, 70% or less, 60% or less, 50% or less, 40% or less, or 30% or less cleavage activity) when compared to the corresponding naturally occurring sequence. In some cases, such a variant Class 2 CRISPR/Cas effector protein is a catalytically 'dead' protein (has substantially no cleavage activity) and can be referred to as a 'dEffector', e.g., dCas12c, dCasY, dCasZ, and the like. In some cases, the variant Class 2 CRISPR/Cas effector protein is a nickase (cleaves only one strand of a double stranded target nucleic acid, e.g., a double stranded target DNA). As described in more detail herein, in some cases, a Class 2 CRISPR/Cas effector protein (in some cases a Class 2 CRISPR/Cas effector protein with wild type cleavage activity and in some cases a variant Class 2 CRISPR/Cas effector protein with reduced cleavage activity, e.g., a dEffector or a nickase) is fused (conjugated) to a heterologous polypeptide that has an activity of interest (e.g., a catalytic activity of interest) to form a fusion protein (a chimeric effector protein). Catalytic residues of a Class 2 CRISPR/Cas effector protein can readily be determined using protein alignments of a domain of interest.

Catalytic residues of Cas12c include D928, E1014, D1201 when numbered according to Cas12c_1 (e.g., see FIG. 1). In some cases, the Cas12c protein has reduced activity and one or more of the above described amino acids (or one or more corresponding amino acids of any Cas12c protein) are mutated (e.g., substituted with an alanine such as D928A, E1014, and/or D1201A when numbered according to Cas12c_1. In some cases, the variant protein is a catalytically 'dead' protein (is catalytically inactive) and is referred to as 'dCas12c.' A dCas12c protein can be fused to a fusion partner that provides an activity, and in some cases, the dCas12c (e.g., one without a fusion partner that provides catalytic activity—but which can have an NLS when expressed in a eukaryotic cell) can bind to target DNA and can be used for imaging (e.g., the protein can be tagged/labeled) and/or can block RNA polymerase from transcribing from a target DNA. In some cases, the variant Cas12c protein is a nickase (cleaves only one strand of a double stranded target nucleic acid, e.g., a double stranded target DNA).

Catalytic residues of CasY include D828, E914, and D1074 when numbered according to CasY1 (e.g., see FIG. 1) (these residues are underlined in FIG. 1 for CasY1). (also see, e.g., the alignments of CasY proteins in the figures). Thus, in some cases, a variant protein has reduced activity and one or more of the above described amino acids (or one or more corresponding amino acids of any CasY protein) are mutated (e.g., substituted with an alanine). In some cases, the variant protein is a catalytically 'dead' protein (is catalytically inactive) and is referred to as 'dCasY.' A dCasY protein can be fused to a fusion partner that provides an activity, and in some cases, the dCasY (e.g., one without a fusion partner that provides catalytic activity—but which can have an NLS when expressed in a eukaryotic cell) can bind to target DNA and can be used for imaging (e.g., the protein can be tagged/labeled) and/or can block RNA polymerase from transcribing from a target DNA. In some cases, the variant CasY protein is a nickase (cleaves only one strand of a double stranded target nucleic acid, e.g., a double stranded target DNA).

Catalytic residues of CasZ include D405, E586 and D684 when numbered according to CasZi.1 (e.g., see FIG. 1). Thus, in some cases, the variant protein has reduced activity and one or more of the above described amino acids (or one or more corresponding amino acids of any CasZ protein) are mutated (e.g., substituted with an alanine). In some cases, the variant protein is a catalytically 'dead' protein (is catalytically inactive) and is referred to as 'dCasZ.' A dCasZ protein can be fused to a fusion partner that provides an activity, and in some cases, the dCasZ (e.g., one without a fusion partner that provides catalytic activity—but which can have an NLS when expressed in a eukaryotic cell) can bind to target DNA and can be used for imaging (e.g., the protein can be tagged/labeled) and/or can block RNA polymerase from transcribing from a target DNA. In some cases, the variant CasZ protein is a nickase (cleaves only one strand of a double stranded target nucleic acid, e.g., a double stranded target DNA).

Variants—Chimeric Class 2 CRISPR/Cas Effector Proteins (i.e., Fusion Proteins)

As noted above, in some cases, a Class 2 CRISPR/Cas effector protein (in some cases with wild type cleavage activity and in some cases a variant protein with reduced cleavage activity, e.g., a dEffector or nickase) is fused (conjugated) to a heterologous polypeptide that has an activity of interest (e.g., a catalytic activity of interest) to form a fusion protein (a chimeric protein). A heterologous polypeptide to which a Class 2 CRISPR/Cas effector protein can be fused is referred to herein as a 'fusion partner.'

In some cases the fusion partner can modulate transcription (e.g., inhibit transcription, increase transcription) of a target DNA. For example, in some cases the fusion partner is a protein (or a domain from a protein) that inhibits transcription (e.g., a transcriptional repressor, a protein that functions via recruitment of transcription inhibitor proteins, modification of target DNA such as methylation, recruitment of a DNA modifier, modulation of histones associated with target DNA, recruitment of a histone modifier such as those that modify acetylation and/or methylation of histones, and the like). In some cases the fusion partner is a protein (or a domain from a protein) that increases transcription (e.g., a transcription activator, a protein that acts via recruitment of transcription activator proteins, modification of target DNA such as demethylation, recruitment of a DNA modifier, modulation of histones associated with target DNA, recruitment of a histone modifier such as those that modify acetylation and/or methylation of histones, and the like).

In some cases, a chimeric Class 2 CRISPR/Cas effector protein includes a heterologous polypeptide that has enzymatic activity that modifies a target nucleic acid (e.g., nuclease activity such as FokI nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity or glycosylase activity).

In some cases, a chimeric Class 2 CRISPR/Cas effector protein includes a heterologous polypeptide that has enzymatic activity that modifies a polypeptide (e.g., a histone) associated with a target nucleic acid (e.g., methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity or demyristoylation activity).

Examples of proteins (or fragments thereof) that can be used in increase transcription include but are not limited to: transcriptional activators such as VP16, VP64, VP48, VP160, p65 subdomain (e.g., from NFkB), and activation domain of EDLL and/or TAL activation domain (e.g., for activity in plants); histone lysine methyltransferases such as SET1A, SET1B, MLL1 to 5, ASH1, SYMD2, NSD1, and the like; histone lysine demethylases such as JHDM2a/b, UTX, JMJD3, and the like; histone acetyltransferases such as GCN5, PCAF, CBP, p300, TAF1, TIP60/PLIP, MOZ/MYST3, MORF/MYST4, SRC1, ACTR, P160, CLOCK, and the like; and DNA demethylases such as Ten-Eleven Translocation (TET) dioxygenase 1 (TET1CD), TET1, DME, DML1, DML2, ROS1, and the like.

Examples of proteins (or fragments thereof) that can be used in decrease transcription include but are not limited to: transcriptional repressors such as the Krüppel associated box (KRAB or SKD); KOX1 repression domain; the Mad mSIN3 interaction domain (SID); the ERF repressor domain (ERD), the SRDX repression domain (e.g., for repression in plants), and the like; histone lysine methyltransferases such as Pr-SET7/8, SUV4-20H1, RIZ1, and the like; histone lysine demethylases such as JMJD2A/JHDM3A, JMJD2B, JMJD2C/GASC1, JMJD2D, JARID1A/RBP2, JARID1B/PLU-1, JARID1C/SMCX, JARID1D/SMCY, and the like; histone lysine deacetylases such as HDAC1, HDAC2, HDAC3, HDAC8, HDAC4, HDAC5, HDAC7, HDAC9, SIRT1, SIRT2, HDAC11, and the like; DNA methylases such as HhaI DNA m5c-methyltransferase (M.HhaI), DNA methyltransferase 1 (DNMT1), DNA methyltransferase 3a (DNMT3a), DNA methyltransferase 3b (DNMT3b), METI, DRM3 (plants), ZMET2, CMT1, CMT2 (plants), and the like; and periphery recruitment elements such as Lamin A, Lamin B, and the like.

In some cases the fusion partner has enzymatic activity that modifies the target nucleic acid (e.g., ssRNA, dsRNA, ssDNA, dsDNA). Examples of enzymatic activity that can be provided by the fusion partner include but are not limited to: nuclease activity such as that provided by a restriction enzyme (e.g., FokI nuclease), methyltransferase activity such as that provided by a methyltransferase (e.g., HhaI DNA m5c-methyltransferase (M.HhaI), DNA methyltransferase 1 (DNMT1), DNA methyltransferase 3a (DNMT3a), DNA methyltransferase 3b (DNMT3b), METI, DRM3 (plants), ZMET2, CMT1, CMT2 (plants), and the like); demethylase activity such as that provided by a demethylase (e.g., Ten-Eleven Translocation (TET) dioxygenase 1 (TET1CD), TET1, DME, DML1, DML2, ROS1, and the like), DNA repair activity, DNA damage activity, deamination activity such as that provided by a deaminase (e.g., a cytosine deaminase enzyme such as rat APOBEC1), dismutase activity, alkylation activity, depurination activity, oxidation activity, pyrimidine dimer forming activity, integrase activity such as that provided by an integrase and/or resolvase (e.g., Gin invertase such as the hyperactive mutant of the Gin invertase, GinH106Y; human immunodeficiency virus type 1 integrase (IN); Tn3 resolvase; and the like), transposase activity, recombinase activity such as that provided by a recombinase (e.g., catalytic domain of Gin recombinase), polymerase activity, ligase activity, helicase activity, photolyase activity, and glycosylase activity).

In some cases the fusion partner has enzymatic activity that modifies a protein associated with the target nucleic acid (e.g., ssRNA, dsRNA, ssDNA, dsDNA) (e.g., a histone, an RNA binding protein, a DNA binding protein, and the like). Examples of enzymatic activity (that modifyies a protein associated with a target nucleic acid) that can be provided by the fusion partner include but are not limited to: methyltransferase activity such as that provided by a histone methyltransferase (HMT) (e.g., suppressor of variegation 3-9 homolog 1 (SUV39H1, also known as KMT1A), euchromatic histone lysine methyltransferase 2 (G9A, also known as KMT1C and EHMT2), SUV39H2, ESET/SETDB1, and the like, SET1A, SET1B, MLL1 to 5, ASH1, SYMD2, NSD1, DOT1L, Pr-SET7/8, SUV4-20H1, EZH2, RIZ1), demethylase activity such as that provided by a histone demethylase (e.g., Lysine Demethylase 1A (KDM1A also known as LSD1), MDM2a/h, JAJD2A/JHDM3A, JMJD2B, JMJD2C/GASC1, JMJD2D, JARID1A/RBP2, JARID1B/PLU-1, JARID1C/SMCX, JARID1D/SMCY, UTX, JMJD3, and the like), acetyltransferase activity such as that provided by a histone acetylase transferase (e.g., catalytic core/fragement of the human acetyltransferase p300, GCN5, PCAF, CBP, TAF1, TIP60/PLIP, MOZ/MYST3, MORF/MYST4, HBO1/MYST2, HMOF/MYST1, SRC1, ACTR, P160, CLOCK, and the like), deacetylase activity such as that provided by a histone deacetylase (e.g., HDAC1, HDAC2, HDAC3, HDAC8, HDAC4, HDAC5, HDAC7, HDAC9, SIRT1, SIRT2, HDAC11, and the like), kinase activity, phosphatasc activity, ubiquitin ligase activity, deubiquitinating activity, adenylation activity, deadenylation activity, SUMOylating activity, deSUMOylating activity, ribosylation activity, deribosylation activity, myristoylation activity, and demyristoylation activity.

An additional examples of a suitable fusion partners are dihydrofolate reductase (DHFR) destabilization domain (e.g., to generate a chemically controllable chimeric Class 2 CRISPR/Cas effector protein), and a chloroplast transit peptide. Suitable chloroplast transit peptides include, but are not limited to:

```
                                        (SEQ ID NO: 122)
MASMISSSAVTTVSRASRGQSAAMAPFGGLKSMTGFPVRKVNTDITSITS

NGGRVKCMQVWPPIGKKKFETLSYLPPLTRDSRA;

(SEQ ID NO: 123)
MASMISSSAVTTVSRASRGQSAAMAPFGGLKSMTGFPVRKVNTDITSITS

NGGRVKS;

(SEQ ID NO: 124)
MASSMLSSATMVASPAQATMVAPFNGLKSSAAFPATRKANNDITSITSNG

GRVNCMQVWPPIEKKKFETLSYLPDLTDSGGRVNC;

(SEQ ID NO: 125)
MAQVSRICNGVQNPSLISNLSKSSQRKSPLSVSLKTQQHPRAYPISSSWG

LKKSGMTLIGSELRPLKVMSSVSTAC;
```

(SEQ ID NO: 126)
MAQVSRICNGVWNPSLISNLSKSSQRKSPLSVSLKTQQHPRAYPISSSWG

LKKSGMTLIGSELRPLKVMSSVSTAC;

(SEQ ID NO: 127)
MAQINNMAQGIQTLNPNSNFHKPQVPKSSSFLVFGSKKLKNSANSMLVLK

KDSIFMQLFCSFRISASVATAC;

(SEQ ID NO: 128)
MAALVTSQLATSGTVLSVTDRFRRPGFQGLRPRNPADAALGMRTVGASAA

PKQSRKPHRFDRRCLSMVV;

(SEQ ID NO: 129)
MAALTTSQLATSATGFGIADRSAPSSLLRHGFQGLKPRSPAGGDATSLSV

TTSARATPKQQRSVQRGSRRFPSVVVC;

(SEQ ID NO: 130)
MASSVLSSAAVATRSNVAQANMVAPFTGLKSAASFPVSRKQNLDITSIAS

NGGRVQC;

(SEQ ID NO: 131)
MESLAATSVFAPSRVAVPAARALVRAGTVVPTRRTSSTSGTSGVKCSAAV

TPQASPVISRSAAAA;
and (SEQ ID NO: 132)
MGAAATSMQSLKFSNRLVPPSRRLSPVPNNVTCNNLPKSAAPVRTVKCCA

SSWNSTINGAAATTNGASAASS.

In some case, a Class 2 CRISPR/Cas effector fusion polypeptide of the present disclosure comprises: a) a Class 2 CRISPR/Cas effector protein; and b) a chloroplast transit peptide. Thus, for example, CRISPR/Cas complex can be targeted to the chloroplast. In some cases, this targeting may be achieved by the presence of an N-terminal extension, called a chloroplast transit peptide (CTP) or plastid transit peptide. Chromosomal transgenes from bacterial sources must have a sequence encoding a CTP sequence fused to a sequence encoding an expressed polypeptide if the expressed polypeptide is to be compartmentalized in the plant plastid (e.g. chloroplast). Accordingly, localization of an exogenous polypeptide to a chloroplast is often 1 accomplished by means of operably linking a polynucleotide sequence encoding a CTP sequence to the 5' region of a polynucleotide encoding the exogenous polypeptide. The CTP is removed in a processing step during translocation into the plastid. Processing efficiency may, however, be affected by the amino acid sequence of the CTP and nearby sequences at the NH 2 terminus of the peptide. Other options for targeting to the chloroplast which have been described are the maize cab-m7 signal sequence (U.S. Pat. No. 7,022,896, WO 97/41228) a pea glutathione reductase signal sequence (WO 97/41228) and the CTP described in U52009029861.

In some cases, a chimeric Class 2 CRISPR/Cas effector protein can comprise: a) a Class 2 CRISPR/Cas effector protein; and b) an endosomal escape peptide. In some cases, an endosomal escape polypeptide comprises the amino acid sequence GLFXALLXLLXSLWXLLLXA (SEQ ID NO: 133), wherein each X is independently selected from lysine, histidine, and arginine. In some cases, an endosomal escape polypeptide comprises the amino acid sequence GLF-HALLHLLHSLWHLLLHA (SEQ ID NO: 134).

For examples of some of the above fusion partners (and more) used in the context of fusions with Cas9, Zinc Finger, and/or TALE proteins (for site specific target nucleic modification, modulation of transcription, and/or target protein modification, e.g., histone modification), see, e.g.: Nomura et al, J Am Chem Soc. 2007 Jul. 18; 129(28):8676-7; Rivenbark et al., Epigenetics. 2012 April; 7(4):350-60; Nucleic Acids Res. 2016 Jul. 8; 44(12):5615-28; Gilbert et al., Cell. 2013 Jul. 18; 154(2):442-51; Kearns et al., Nat Methods. 2015 May; 12(5):401-3; Mendenhall et al., Nat Biotechnol. 2013 December; 31(12):1133-6; Hilton et at, Nat Biotechnol. 2015 May; 33(5):510-7; Gordley et al., Proc Natl Acad Sci USA. 2009 Mar. 31; 106(13):5053-8; Akopian et al., Proc Natl Acad Sci USA. 2003 Jul. 22; 100(15):8688-91; Tan et., al., J Virol. 2006 February; 80(4):1939-48; Tan et al., Proc Natl Acad Sci USA. 2003 Oct. 14; 100(21):11997-2002; Papworth et al., Proc Natl Acad Sci USA. 2003 Feb. 18; 100(4):1621-6; Sanjana et al., Nat Protoc. 2012 Jan. 5; 7(1):171-92; Beerli et al., Proc Natl Acad Sci USA. 1998 Dec. 8; 95(25):14628-33; Snowden et al., Curr Biol. 2002 Dec. 23; 12(24):2159-66; Xu et. al., Xu et al., Cell Discov. 2016 May 3; 2:16009; Komor et al., Nature. 2016 Apr. 20; 533(7603):420-4; Chaikind et al., Nucleic Acids Res. 2016 Aug. 11; Choudhury at. al., Oncotarget. 2016 Jun. 23; Du et al., Cold Spring Harb Protoc. 2016 Jan. 4; Pham et al., Methods Mol Biol. 2016; 1358:43-57; Balboa et al., Stem Cell Reports. 2015 Sep. 8; 5(3):448-59; Hara et al., Sci Rep. 2015 Jun. 9; 5:11221; Piatek et al., Plant Biotechnol J. 2015 May; 13(4):578-89; Hu et al., Nucleic Acids Res. 2014 April; 42(7):4375-90; Cheng et al., Cell Res. 2013 October; 23(10):1163-71; and Maeder et al., Nat Methods. 2013 October; 10(10):977-9.

Additional suitable heterologous polypeptide include, but are not limited to, a polypeptide that directly and/or indirectly provides for increased transcription and/or translation of a target nucleic acid (e.g., a transcription activator or a fragment thereof, a protein or fragment thereof that recruits a transcription activator, a small molecule/drug-responsive transcription and/or translation regulator, a translation-regulating protein, etc.). Non-limiting examples of heterologous polypeptides to accomplish increased or decreased transcription include transcription activator and transcription repressor domains. In some such cases, a chimeric Class 2 CRISPR/Cas effector protein is targeted by the guide nucleic acid (guide RNA) to a specific location (i.e., sequence) in the target nucleic acid and exerts locus-specific regulation such as blocking RNA polymerase binding to a promoter (which selectively inhibits transcription activator function), and/or modifying the local chromatin status (e.g., when a fusion sequence is used that modifies the target nucleic acid or modifies a polypeptide associated with the target nucleic acid). In some cases, the changes are transient (e.g., transcription repression or activation). In some cases, the changes are inheritable (e.g., when epigenetic modifications are made to the target nucleic acid or to proteins associated with the target nucleic acid, e.g., nucleosomal histones).

Non-limiting examples of heterologous polypeptides for use when targeting ssRNA target nucleic acids include (but are not limited to): splicing factors (e.g., RS domains); protein translation components (e.g., translation initiation, elongation, and/or release factors; e.g., eIF4G); RNA methylases; RNA editing enzymes (e.g., RNA deaminases, e.g., adenosine deaminase acting on RNA (ADAR), including A to I and/or C to U editing enzymes); helicases; RNA-binding proteins; and the like. It is understood that a heterologous polypeptide can include the entire protein or in some cases can include a fragment of the protein (e.g., a functional domain)

The heterologous polypeptide of a subject chimeric Class 2 CRISPR/Cas effector protein can be any domain capable of interacting with ssRNA (which, for the purposes of this disclosure, includes intramolecular and/or intermolecular secondary structures, e.g., double-stranded RNA duplexes such as hairpins, stem-loops, etc.), whether transiently or irreversibly, directly or indirectly, including but not limited to an effector domain selected from the group comprising; Endonucleases (for example RNase III, the CRR22 DYW domain, Dicer, and PIN (PilT N-terminus) domains from proteins such as SMG5 and SMG6); proteins and protein domains responsible for stimulating RNA cleavage (for example CPSF, CstF, CFIm and CFIIm); Exonucleases (for example XRN-1 or Exonuclease T); Deadenylases (for example HNT3); proteins and protein domains responsible for nonsense mediated RNA decay (for example UPF1, UPF2, UPF3, UPF3b, RNP S1, Y14, DEK, REF2, and SRm160); proteins and protein domains responsible for stabilizing RNA (for example PABP); proteins and protein domains responsible for repressing translation (for example Agog and Ago4); proteins and protein domains responsible for stimulating translation (for example Staufen); proteins and protein domains responsible for (e.g., capable of) modulating translation (e.g., translation factors such as initiation factors, elongation factors, release factors, etc., e.g., eIF4G); proteins and protein domains responsible for polyadenylation of RNA (for example PAP1, GLD-2, and Star-PAP); proteins and protein domains responsible for polyuridinylation of RNA (for example CI D1 and terminal uridylate transferase); proteins and protein domains responsible for RNA localization (for example from IMP1, ZBP1, She2p, She3p, and Bicaudal-D); proteins and protein domains responsible for nuclear retention of RNA (for example Rrp6); proteins and protein domains responsible for nuclear export of RNA (for example TAP, NXF1, THO, TREX, REF, and Aly); proteins and protein domains responsible for repression of RNA splicing (for example PTB, Sam68, and hnRNP A1); proteins and protein domains responsible for stimulation of RNA splicing (for example Serine/Arginine-rich (SR) domains); proteins and protein domains responsible for reducing the efficiency of transcription (for example FUS (TLS)); and proteins and protein domains responsible for stimulating transcription (for example CDK7 and HIV Tat). Alternatively, the effector domain may be selected from the group comprising Endonucleases; proteins and protein domains capable of stimulating RNA cleavage; Exonucleases; Deadenylases; proteins and protein domains having nonsense mediated RNA decay activity; proteins and protein domains capable of stabilizing RNA; proteins and protein domains capable of repressing translation; proteins and protein domains capable of stimulating translation; proteins and protein domains capable of modulating translation (e.g., translation factors such as initiation factors, elongation factors, release factors, etc., e.g., eIF4G); proteins and protein domains capable of polyadenylation of RNA; proteins and protein domains capable of polyuridinylation of RNA; proteins and protein domains having RNA localization activity; proteins and protein domains capable of nuclear retention of RNA; proteins and protein domains having RNA nuclear export activity; proteins and protein domains capable of repression of RNA splicing; proteins and protein domains capable of stimulation of RNA splicing; proteins and protein domains capable of reducing the efficiency of transcription; and proteins and protein domains capable of stimulating transcription. Another suitable heterologous polypeptide is a PUF RNA-binding domain, which is described in more detail in WO2012068627, which is hereby incorporated by reference in its entirety.

Some RNA splicing factors that can be used (in whole or as fragments thereof) as heterologous polypeptides for a chimeric Class 2 CRISPR/Cas effector protein have modular organization, with separate sequence-specific RNA binding modules and splicing effector domains. For example, members of the Serine/Arginine-rich (SR) protein family contain N-terminal RNA recognition motifs (RRMs) that bind to exonic splicing enhancers (ESEs) in pre-mRNAs and C-terminal RS domains that promote exon inclusion. As another example, the hnRNP protein hnRNP A1 binds to exonic splicing silencers (ESSs) through its RRM domains and inhibits exon inclusion through a C-terminal Glycine-rich domain Some splicing factors can regulate alternative use of splice site (ss) by binding to regulatory sequences between the two alternative sites. For example, ASF/SF2 can recognize ESEs and promote the use of intron proximal sites, whereas hnRNP A1 can bind to ESSs and shift splicing towards the use of intron distal sites. One application for such factors is to generate ESFs that modulate alternative splicing of endogenous genes, particularly disease associated genes. For example, Bcl-x pre-mRNA produces two splicing isoforms with two alternative 5' splice sites to encode proteins of opposite functions. The long splicing isoform Bcl-xL is a potent apoptosis inhibitor expressed in long-lived postmitotic cells and is up-regulated in many cancer cells, protecting cells against apoptotic signals. The short isoform Bcl-xS is a pro-apoptotic isoform and expressed at high levels in cells with a high turnover rate (e.g., developing lymphocytes). The ratio of the two Bcl-x splicing isoforms is regulated by multiple c$\omega$-elements that are located in either the core exon region or the exon extension region (i.e., between the two alternative 5' splice sites). For more examples, see WO2010075303, which is hereby incorporated by reference in its entirety.

Further suitable fusion partners include, but are not limited to proteins (or fragments thereof) that are boundary elements (e.g., CTCF), proteins and fragments thereof that provide periphery recruitment (e.g., Lamin A, Lamin B, etc.), protein docking elements (e.g., FKBP/FRB, Pil1/Aby1, etc.).

Examples of various additional suitable heterologous polypeptide (or fragments thereof) for a subject chimeric Class 2 CRISPR/Cas effector protein include, but are not limited to those described in the following applications (which publications are related to other CRISPR endonucleases such as Cas9): PCT patent applications: WO2010075303, WO2012068627, and WO2013155555, and can be found, for example, in U.S. patents and patent applications: U.S. Pat. Nos. 8,906,616; 8,895,308; 8,889,418; 8,889,356; 8,871,445; 8,865,406; 8,795,965; 8,771,945; 8,697,359; 20140068797; 20140170753; 20140179006; 20140179770; 20140186843; 20140186919; 20140186958; 20140189896; 20140227787; 20140234972; 20140242664; 20140242699; 20140242700; 20140242702; 20140248702; 20140256046; 20140273037; 20140273226; 20140273230; 20140273231; 20140273232; 20140273233; 20140273234; 20140273235; 20140287938; 20140295556; 20140295557; 20140298547; 20140304853; 20140309487; 20140310828; 20140310830; 20140315985; 20140335063; 20140335620; 20140342456; 20140342457; 20140342458; 20140349400; 20140349405; 20140356867; 20140356956; 20140356958; 20140356959; 20140357523; 20140357530; 20140364333; and 20140377868; all of which are hereby incorporated by reference in their entirety.

In some cases, a heterologous polypeptide (a fusion partner) provides for subcellular localization, i.e., the heterologous polypeptide contains a subcellular localization sequence (e.g., a nuclear localization signal (NLS) for targeting to the nucleus, a sequence to keep the fusion protein out of the nucleus, e.g., a nuclear export sequence (NES), a sequence to keep the fusion protein retained in the cytoplasm, a mitochondrial localization signal for targeting to the mitochondria, a chloroplast localization signal for targeting to a chloroplast, an ER retention signal, and the like). In some embodiments, a Class 2 CRISPR/Cas effector protein fusion polypeptide does not include a NLS so that the protein is not targeted to the nucleus (which can be advantageous, e.g., when the target nucleic acid is an RNA that is present in the cyosol). In some embodiments, the heterologous polypeptide can provide a tag (i.e., the heterologous polypeptide is a detectable label) for ease of tracking and/or purification (e.g., a fluorescent protein, e.g., green fluorescent protein (GFP), YFP, RFP, CFP, mCherry, tdTomato, and the like; a histidine tag, e.g., a 6×His tag; a hemagglutinin (HA) tag; a FLAG tag; a Myc tag; and the like).

In some cases a Class 2 CRISPR/Cas effector protein (e.g., a wild type protein such as Cas12c, CasY, CasZ, and the like; variant protein, a chimeric Class 2 CRISPR/Cas effector protein, a dEffector protein, a chimeric protein where the Class 2 CRISPR/Cas effector portion has reduced nuclease activity—such as a dEffector protein fused to a fusion partner, and the like) includes (is fused to) a nuclear localization signal (NLS) (e.g, in some cases 2 or more, 3 or more, 4 or more, or 5 or more NLSs). Thus, in some cases, a Class 2 CRISPR/Cas effector protein includes one or more NLSs (e.g., 2 or more, 3 or more, 4 or more, or 5 or more NLSs). In some cases, one or more NLSs (2 or more, 3 or more, 4 or more, or 5 or more NLSs) are positioned at or near (e.g., within 50 amino acids of) the N-terminus and/or the C-terminus. In some cases, one or more NLSs (2 or more, 3 or more, 4 or more, or 5 or more NLSs) are positioned at or near (e.g., within 50 amino acids of) the N-terminus. In some cases, one or more NLSs (2 or more, 3 or more, 4 or more, or 5 or more NLSs) are positioned at or near (e.g., within 50 amino acids of) the C-terminus. In some cases, one or more NLSs (3 or more, 4 or more, or 5 or more NLSs) are positioned at or near (e.g., within 50 amino acids of) both the N-terminus and the C-terminus. In some cases, an NLS is positioned at the N-terminus and an NLS is positioned at the C-terminus.

In some cases a Class 2 CRISPR/Cas effector protein (e.g., a wild type protein, a variant protein, a chimeric protein, a dEffector protein, a chimeric protein where the Class 2 CRISPR/Cas effector portion has reduced nuclease activity—such as a Class 2 CRISPR/Cas effector protein fused to a fusion partner, and the like) includes (is fused to) between 1 and 10 NLSs (e.g., 1-9, 1-8, 1-7, 1-6, 1-5, 2-10, 2-9, 2-8, 2-7, 2-6, or 2-5 NLSs). In some cases a Class 2 CRISPR/Cas effector protein (e.g., a wild type protein, a variant protein, a chimeric protein, a dEffector protein, a chimeric protein where the Class 2 CRISPR/Cas effector portion has reduced nuclease activity—such as a Class 2 CRISPR/Cas effector protein fused to a fusion partner, and the like) includes (is fused to) between 2 and 5 NLSs (e.g., 2-4, or 2-3 NLSs).

Non-limiting examples of NLSs include an NLS sequence derived from: the NLS of the SV40 virus large T-antigen, having the amino acid sequence PKKKRKV (SEQ ID NO: 135); the NLS from nucleoplasmin (e.g., the nucleoplasmin bipartite NLS with the sequence KRPAATKKAGQAKKKK (SEQ ID NO: 136)); the c-myc NLS having the amino acid sequence PAAKRVKLD (SEQ ID NO: 137) or RQRRNELKRSP (SEQ ID NO: 138); the hRNPA1 M9 NLS having the sequence NQSSNFGPMKGGNFGGRSSGPYGGGGQYFAKPRNQGGY (SEQ ID NO: 139); the sequence RMRIZFKNKGKDTAELRRRRVEVS-VELRKAKKDEQILKRRNV (SEQ ID NO: 140) of the IBB domain from importin-alpha; the sequences VSRKRPRP (SEQ ID NO: 141) and PPKKARED (SEQ ID NO: 142) of the myoma T protein; the sequence PQPKKKPL (SEQ ID NO: 143) of human p53; the sequence SALIKKKKKMAP (SEQ ID NO: 144) of mouse c-abl IV; the sequences DRLRR (SEQ ID NO: 145) and PKQKKRK (SEQ ID NO: 146) of the influenza virus NS1; the sequence RKLKKKIKKL (SEQ ID NO: 147) of the Hepatitis virus delta antigen; the sequence REKKKFLKRR (SEQ ID NO: 148) of the mouse Mx1 protein; the sequence KRKGDEVDGVDEVAKKKSKK (SEQ ID NO: 149) of the human poly(ADP-ribose) polymerase; and the sequence RKCLQAGMNLEARKTKK (SEQ ID NO: 150) of the steroid hormone receptors (human) glucocorticoid. In general, NLS (or multiple NLSs) are of sufficient strength to drive accumulation of the Class 2 CRISPR/Cas effector protein in a detectable amount in the nucleus of a eukaryotic cell. Detection of accumulation in the nucleus may be performed by any suitable technique. For example, a detectable marker may be fused to the Class 2 CRISPR/Cas effector protein such that location within a cell may be visualized. Cell nuclei may also be isolated from cells, the contents of which may then be analyzed by any suitable process for detecting protein, such as immunohistochemistry, Western blot, or enzyme activity assay. Accumulation in the nucleus may also be determined indirectly.

In some cases, a Class 2 CRISPR/Cas effector protein fusion polypeptide includes a "Protein Transduction Domain" or PTD (also known as a CPP—cell penetrating peptide), which refers to a polypeptide, polynucleotide, carbohydrate, or organic or inorganic compound that facilitates traversing a lipid bilayer, micelle, cell membrane, organelle membrane, or vesicle membrane. A PTD attached to another molecule, which can range from a small polar molecule to a large macromolecule and/or a nanoparticle, facilitates the molecule traversing a membrane, for example going from extracellular space to intracellular space, or cytosol to within an organelle. In some embodiments, a PTD is covalently linked to the amino terminus a polypeptide (e.g., linked to a wild type Class 2 CRISPR/Cas effector protein to generate a fusion protein, or linked to a variant Class 2 CRISPR/Cas effector protein such as a a dEffector protein, a nickase, or chimeric Class 2 CRISPR/Cas effector protein to generate a fusion protein). In some embodiments, a PTD is covalently linked to the carboxyl terminus of a polypeptide (e.g., linked to a wild type Class 2 CRISPR/Cas effector protein to generate a fusion protein, or linked to a variant Class 2 CRISPR/Cas effector protein such as a dEffector protein, a nickase, or chimeric Class 2 CRISPR/Cas effector protein to generate a fusion protein). In some cases, the PTD is inserted internally in the Class 2 CRISPR/Cas effector protein (i.e., is not at the N- or C-terminus of the Class 2 CRISPR/Cas effector protein fusion polypeptide) at a suitable insertion site. In some cases, a subject Class 2 CRISPR/Cas effector protein includes (is conjugated to, is fused to) one or more PTDs (e.g., two or more, three or more, four or more PTDs). In some cases a PTD includes a nuclear localization signal (NLS) (e.g, in some cases 2 or more, 3 or more, 4 or more, or 5 or more NLSs). Thus, in some cases, a Class 2 CRISPR/Cas effector protein fusion polypeptide includes one or more NLSs (e.g., 2 or more, 3 or more, 4 or more, or 5 or more NLSs). In some embodiments, a PTD is covalently linked to a nucleic acid (e.g., a CRISP/Cas guide nucleic acid, a polynucleotide encoding a CRISP/Cas guide nucleic acid, a polynucleotide encoding a lass 2 CRISPR/Cas effector protein fusion polypeptide, a donor polynucleotide, etc.). Examples of PTDs include but are not limited to a minimal undecapeptide protein transduction domain (corresponding to residues 47-57 of HIV-1 TAT comprising YGRKKRRQRRR; SEQ ID NO: 151); a polyarginine sequence comprising a number of arginines sufficient to direct entry into a cell (e.g., 3, 4, 5, 6, 7, 8, 9, 10, or 10-50 arginines); a VP22 domain (Zender et at (2002) Cancer Gene Ther. 9(6):489-96); an Drosophila Antannapedia protein transduction domain (Noguchi et al. (2003) Diabetes 52(7):1732-1737); a truncated human calcitonin peptide (Trehin et al. (2004) Pharm. Research 21:1248-1256); polylysine (Wender et al. (2000) Proc. Natl. Acad. Sci. USA 97:13003-13008); RRQRRTSKLMKR (SEQ ID NO: 152); Transportan GWTLNSAGYLLGKINLKA-LAALAKKIL (SEQ ID NO: 153); KALAWEAKLAKA-LAKALAKHLAKALAKALKCEA (SEQ ID NO: 154); and RQIKIWFQNRRMKWKK (SEQ ID NO: 155). Exemplary PTDs include but are not limited to, YGRKKRRQRRR (SEQ ID NO: 151), RKKRRQRRR (SEQ ID NO: 157); an arginine homopolymer of from 3 arginine residues to 50 arginine residues; Exemplary PTD domain amino acid sequences include, but are not limited to, any of the following: YGRKKRRQRRR (SEQ ID NO: 151); RKKRRQRR (SEQ ID NO: 159); YARAAARQARA (SEQ ID NO: 160); THRLPRRRRRR (SEQ ID NO: 161); and GGR-RARRRRRR (SEQ ID NO: 162). In some embodiments, the PTD is an activatable CPP (ACPP) (Aguilera et al. (2009) Integr Biol (Camb) June; 1(5-6): 371-381). ACPPs comprise a polycationic CPP (e.g., Arg9 or "R9") connected via a cleavable linker to a matching polyanion (e.g., Glu9 or "E9"), which reduces the net charge to nearly zero and thereby inhibits adhesion and uptake into cells. Upon cleavage of the linker, the polyanion is released, locally unmasking the polyarginine and its inherent adhesiveness, thus "activating" the ACPP to traverse the membrane.

Linkers (e.g., for Fusion Partners)

In some embodiments, a subject Class 2 CRTSPR/Cas effector protein can fused to a fusion partner via a linker polypeptide (e.g., one or more linker polypeptides). The linker polypeptide may have any of a variety of amino acid sequences. Proteins can be joined by a spacer peptide, generally of a flexible nature, although other chemical linkages are not excluded. Suitable linkers include polypeptides of between 4 amino acids and 40 amino acids in length, or between 4 amino acids and 25 amino acids in length. These linkers can be produced by using synthetic, linker-encoding oligonucleotides to couple the proteins, or can be encoded by a nucleic acid sequence encoding the fusion protein. Peptide linkers with a degree of flexibility can be used. The linking peptides may have virtually any amino acid sequence, bearing in mind that the preferred linkers will have a sequence that results in a generally flexible peptide. The use of small amino acids, such as glycine and alanine, are of use in creating a flexible peptide. The creation of such sequences is routine to those of skill in the art. A variety of different linkers are commercially available and are considered suitable for use.

Examples of linker polypeptides include glycine polymers (G)$_n$, glycine-serine polymers (including, for example, (GS)$_n$, GSGGS$_n$ (SEQ ID NO: 163). GGSGGS$_n$ (SEQ ID NO: 164), and GGGS$_n$ (SEQ ID NO: 165), where n is an integer of at least one), glycine-alanine polymers, alanine-serine polymers. Exemplary linkers can comprise amino acid sequences including, but not limited to, GGSG (SEQ ID NO: 166), GGSGG (SEQ ID NO: 167), GSGSG (SEQ ID NO: 168), GSGGG (SEQ ID NO: 169), GGGSG (SEQ ID NO: 170), GSSSG (SEQ ID NO: 171), and the like. The ordinarily skilled artisan will recognize that design of a peptide conjugated to any desired element can include linkers that are all or partially flexible, such that the linker can include a flexible linker as well as one or more portions that confer less flexible structure.

Detectable Labels

In some cases, a Class 2 CRISPR/Cas effector protein comprises (can be attached/fused to) a detectable label. Suitable detectable labels and/or moieties that can provide a detectable signal can include, but are not limited to, an enzyme, a radioisotope, a member of a specific binding pair; a fluorophore; a fluorescent protein; a quantum dot; and the like.

Suitable fluorescent proteins include, but are not limited to, green fluorescent protein (GFP) or variants thereof, blue fluorescent variant of GFP (BFP), cyan fluorescent variant of GFP (CFP), yellow fluorescent variant of GFP (YFP), enhanced GFP (EGFP), enhanced CFP (ECFP), enhanced YFP (EYFP), GFPS65T, Emerald, Topaz (TYFP), Venus, Citrine, mCitrine, GFPuv, destabilised EGFP (dEGFP), destabilised ECFP (dECFP), destabilised EYFP (dEYFP), mCFPm, Cerulean, T-Sapphire, CyPet, YPet, mKO, HcRed, t-HcRed, DsRed, DsRed2, DsRed-monomer, J-Red, dimer2, t-dimer2(12), mRFP1, pocilloporin, Renilla GFP, Monster GFP, paGFP, Kaede protein and kindling protein, Phycobiliproteins and Phycobiliprotein conjugates including B-Phycoerythrin, R-Phycoerythrin and Allophycocyanin. Other examples of fluorescent proteins include mHoneydew, mBanana, mOrange, dTomato, tdTomato, mTangerine, mStrawberry, mCherry, mGrape1, mRaspberry, mGrape2, mPlum (Shaner et al. (2005) Nat. Methods 2:905-909), and the like. Any of a variety of fluorescent and colored proteins from Anthozoan species, as described in, e.g., Matz et al. (1999) Nature Biotechnol. 17:969-973, is suitable for use.

Suitable enzymes include, but are not limited to, horse radish peroxidase (HRP), alkaline phosphatase (AP), beta-galactosidase (GAL), glucose-6-phosphate dehydrogenase, beta-N-acetylglucosaminidase, β-glucuronidase, invertase, Xanthine Oxidase, firefly luciferase, glucose oxidase (GO), and the like.

Protospacer Adjacent Motif (PAM)

A natural Class 2 CRISPR/Cas effector protein binds to target DNA at a target sequence defined by the region of complementarity between the DNA-targeting RNA and the target DNA. As is the case for many CRISPR endonucleases, site-specific binding (and/or cleavage) of a double stranded target DNA occurs at locations determined by both (i) base-pairing complementarity between the guide RNA and the target DNA; and (ii) a short motif [referred to as the protospacer adjacent motif (PAM)] in the target DNA. In some embodiments, the PAM for a Class 2 CRISPR/Cas effector protein (e.g., CasZ, CasY, Cas12c) is immediately 5' of the target sequence of the non-complementary strand of the target DNA (also referred to as the non-target strand; the complementary strand hybridizes to the guide sequence of the guide RNA while the non-complementary strand does not directly hybridize with the guide RNA and is the reverse complement of the non-complementary strand).

In some embodiments (e.g., for Cas12c_1), the preferred PAM sequence (of the non-complementary strand) is 5'-TA-3', 5'-TN-3', 5'-TR-3', 5'-HN-3', 5'-HR-3', 5'-MCTA-3', 5'-MCTR-3', 5'-CTA-3', or 5'-CTR-3' (where R is an A or G; and H is an A, C, or T; and M is C or A) flanking sequence 5' of the target sequence in the non-target (NT) strand (also referred to as the non-complementary strand because it is not the strand that hybridizes with the guide RNA). In some embodiments (e.g., for Cas12c_1), the preferred PAM sequence (of the non-complementary strand) is 5'-TA-3'. In some embodiments (e.g., for Cas12c_1), the preferred PAM sequence (of the non-complementary strand) is 5'-TN-3. In some embodiments (e.g., for Cas12c_1), the preferred PAM sequence (of the non-complementary strand) is 5'-TA-3'. In some embodiments (e.g., for Cas12c_1), the preferred PAM sequence (of the non-complementary strand) is selected from: 5'-HN-3', 5'-HR-3', 5'-MCTA-3', 5'-MCTR-3', 5'-CTA-3', and 5'-CTR-3'.

In some embodiments (e.g., for CasY1), the preferred PAM sequence (of the non-complementary strand/non-target strand) is 5'-TA-3' (and in some cases XTA, where X is C, A, or T). In some embodiments (e.g., when CasY1 as described herein is used), the PAM sequence of the non-complementary strand is 5'-TA-3' (in some cases CTA and in some cases HTA, where H is C, A, or T). In some cases (e.g., when CasY2 as described herein is used), the PAM sequence of the non-complementary strand is a 5'-YR-3' flanking sequence 5' of the target (where Y is a T or C and R is an A or G). In some cases (e.g., when CasY2 as described herein is used), the PAM sequence of the non-complementary strand is 5'-TR-3' (e.g., 5'-DTR-3') (where R is an A or C and D is an A, G, or T).

In some embodiments (e.g., for CasZc), the PAM sequence of the non-complementary strand is 5'-TTA-3'. In some embodiments (e.g., for CasZb), the PAM sequence of the non-complementary strand is 5'-TTTN-3'. In some embodiments (e.g., for CasZb), the PAM sequence of the non-complementary strand is 5'-TTTA-3'.

In some cases, different Class 2 CRISPR/Cas effector proteins (i.e., Class 2 CRISPR/Cas effector proteins from various species) may be advantageous to use in the various provided methods in order to capitalize on various enzymatic characteristics of the different effector proteins (e.g., for different PAM sequence preferences; for increased or decreased enzymatic activity; for an increased or decreased level of cellular toxicity; to change the balance between NHEJ, homology-directed repair, single strand breaks, double strand breaks, etc.; to take advantage of a short total sequence; and the like). Class 2 CRISPR/Cas effector proteins from different species may require different PAM sequences in the target DNA. Thus, for a particular Class 2 CRISPR/Cas effector protein of choice, the PAM sequence preference may be different than the sequence(s) described above. Various methods (including in silico and/or wet lab methods) for identification of the appropriate PAM sequence are known in the art and are routine, and any convenient method can be used.

CRISPR/Cas Guide RNA

A nucleic acid molecule that binds to a Class 2 CRISPR/Cas effector protein, forming a ribonucleoprotein complex (RNP), and targets the complex to a specific location within a target nucleic acid (e.g., a target DNA) is referred to herein as a "CRISPR/Cas guide RNA" or simply as a "guide RNA." It is to be understood that in some cases, a hybrid DNA/RNA can be made such that a CRISPR/Cas guide RNA includes DNA bases in addition to RNA bases, but the term "CRISPR/Cas guide RNA" is still used to encompass such a molecule herein.

A CRISPR/Cas guide RNA can be said to include two segments, a targeting segment and a protein-binding segment. The targeting segment of a CRISPR/Cas guide RNA includes a nucleotide sequence (a guide sequence) that is complementary to (and therefore hybridizes with) a specific sequence (a target site) within a target nucleic acid (e.g., a target ssRNA, a target ssDNA, the complementary strand of a double stranded target DNA, etc.). The protein-binding segment (or "protein-binding sequence") interacts with (binds to) a Class 2 CRISPR/Cas effector protein. The protein-binding segment of a subject CRISPR/Cas guide RNA includes two complementary stretches of nucleotides that hybridize to one another to form a double stranded RNA duplex (dsRNA duplex). Site-specific binding and/or cleavage of a target nucleic acid (e.g., genomic DNA) can occur at locations (e.g., target sequence of a target locus) determined by base-pairing complementarity between the CRISPR/Cas guide RNA (the guide sequence of the CRISPR/Cas guide RNA) and the target nucleic acid.

A CRISPR/Cas guide RNA and a Class 2 CRISPR/Cas effector protein, e.g., a fusion Class 2 CRISPR/Cas effector protein, form a complex (e.g., bind via non-covalent interactions). The CRISPR/Cas guide RNA provides target specificity to the complex by including a targeting segment, which includes a guide sequence (a nucleotide sequence that is complementary to a sequence of a target nucleic acid). The Class 2 CRISPR/Cas effector protein of the complex provides the site-specific activity (e.g., cleavage activity provided by the Class 2 CRISPR/Cas effector protein and/or an activity provided by the fusion partner in the case of a chimeric Class 2 CRISPR/Cas effector protein). In other words, the Class 2 CRISPR/Cas effector protein is guided to a target nucleic acid sequence (e.g. a target sequence) by virtue of its association with the CRISPR/Cas guide RNA.

The "guide sequence" also referred to as the "targeting sequence" of a CRISPR/Cas guide RNA can be modified so that the CRISPR/Cas guide RNA can target a Class 2 CRISPR/Cas effector protein (e.g., a naturally occurring Class 2 CRISPR/Cas effector protein, a fusion Class 2 CRISPR/Cas effector protein (chimeric effector), and the like) to any desired sequence of any desired target nucleic acid, with the exception (e.g., as described herein) that the PAM sequence can be taken into account. Thus, for example, a CRISPR/Cas guide RNA can have a guide sequence with complementarity to (e.g., can hybridize to) a sequence in a nucleic acid in a eukaryotic cell, e.g., a viral nucleic acid, a eukaryotic nucleic acid (e.g., a eukaryotic chromosome, chromosomal sequence, a eukaryotic RNA, etc.), and the like.

In some embodiments, a CRISPR/Cas guide RNA has a length of 30 nucleotides (nt) or more (e.g., 35 nt or more, 40 nt or more, 45 nt or more, 50 nt or more, 55 nt or more, or 60 nt or more). In some embodiments, a CRISPR/Cas guide RNA has a length of 40 nucleotides (nt) or more (e.g., 45 nt or more, 50 nt or more, 55 nt or more, or 60 nt or more). In some embodiments, a CRISPR/Cas guide RNA has a length of from 30 nucleotides (nt) to 100 nt (e.g., 30-90, 30-80, 30-75, 30-70, 30-65, 40-100, 40-90, 40-80, 40-75, 40-70, or 40-65 nt). In some embodiments, a CRISPR/Cas guide RNA has a length of from 40 nucleotides (nt) to 100 nt (e.g., 40-90, 40-80, 40-75, 40-70, or 40-65 nt).

Guide Sequence of a CRISPR/Cas Guide RNA

A subject CRISPR/Cas guide RNA includes a guide sequence (i.e., a targeting sequence), which is a nucleotide sequence that is complementary to a sequence (a target site) in a target nucleic acid. In other words, the guide sequence of a CRISPR/Cas guide RNA can interact with a target nucleic acid (e.g., double stranded DNA (dsDNA), single stranded DNA (ssDNA), single stranded RNA (ssRNA), or double stranded RNA (dsRNA)) in a sequence-specific manner via hybridization (i.e., base pairing). The guide sequence of a CRISPR/Cas guide RNA can be modified (e.g., by genetic engineering)/designed to hybridize to any desired target sequence (e.g., while taking the PAM into account, e.g., when targeting a dsDNA target) within a target nucleic acid (e.g., a eukaryotic target nucleic acid such as genomic DNA).

In some embodiments, the percent complementarity between the guide sequence and the target site of the target nucleic acid is 60% or more (e.g., 65% or more, 70% or more, 75% or more, 80% or more, 85% or more, 90% or more, 95% or more, 97% or more, 98% or more, 99% or more, or 100%). In some cases, the percent complementarity between the guide sequence and the target site of the target nucleic acid is 80% or more (e.g., 85% or more, 90% or more, 95% or more, 97% or more, 98% or more, 99% or more, or 100%). In some cases, the percent complementarity between the guide sequence and the target site of the target nucleic acid is 90% or more (e.g., 95% or more, 97% or more, 98% or more, 99% or more, or 100%). In some cases, the percent complementarity between the guide sequence and the target site of the target nucleic acid is 100%.

In some cases, the percent complementarity between the guide sequence and the target site of the target nucleic acid is 100% over the seven contiguous 3'-most nucleotides of the target site of the target nucleic acid.

In some cases, the percent complementarity between the guide sequence and the target site of the target nucleic acid is 60% or more (e.g., 70% or more, 75% or more, 80% or more, 85% or more, 90% or more, 95% or more, 97% or more, 98% or more, 99% or more, or 100%) over 17 or more (e.g., 18 or more, 19 or more, 20 or more, 21 or more, 22 or more) contiguous nucleotides. In some cases, the percent complementarity between the guide sequence and the target site of the target nucleic acid is 80% or more (e.g., 85% or more, 90% or more, 95% or more, 97% or more, 98% or more, 99% or more, or 100%) over 17 or more (e.g., 18 or more, 19 or more, 20 or more, 21 or more, 22 or more) contiguous nucleotides. In some cases, the percent complementarity between the guide sequence and the target site of the target nucleic acid is 90% or more (e.g., 95% or more, 97% or more, 98% or more, 99% or more, or 100%) over 17 or more (e.g., 18 or more, 19 or more, 20 or more, 21 or more, 22 or more) contiguous nucleotides. In some cases, the percent complementarity between the guide sequence and the target site of the target nucleic acid is 100% over 17 or more (e.g., 18 or more, 19 or more, 20 or more, 21 or more, 22 or more) contiguous nucleotides.

In some cases, the percent complementarity between the guide sequence and the target site of the target nucleic acid is 60% or more (e.g., 70% or more, 75% or more, 80% or more, 85% or more, 90% or more, 95% or more, 97% or more, 98% or more, 99% or more, or 100%) over 19 or more (e.g., 20 or more, 21 or more, 22 or more) contiguous nucleotides. In some cases, the percent complementarity between the guide sequence and the target site of the target nucleic acid is 80% or more (e.g., 85% or more, 90% or more, 95% or more, 97% or more, 98% or more, 99% or more, or 100%) over 19 or more (e.g., 20 or more, 21 or more, 22 or more) contiguous nucleotides. In some cases, the percent complementarity between the guide sequence and the target site of the target nucleic acid is 90% or more (e.g., 95% or more, 97% or more, 98% or more, 99% or more, or 100%) over 19 or more (e.g., 20 or more, 21 or more, 22 or more) contiguous nucleotides. In some cases, the percent complementarity between the guide sequence and the target site of the target nucleic acid is 100% over 19 or more (e.g., 20 or more, 21 or more, 22 or more) contiguous nucleotides.

In some cases, the percent complementarity between the guide sequence and the target site of the target nucleic acid is 60% or more (e.g., 70% or more, 75% or more, 80% or more, 85% or more, 90% or more, 95% or more, 97% or more, more, 98% or more, 99% or more, or 100%) over 17-25 contiguous nucleotides. In some cases, the percent complementarity between the guide sequence and the target site of the target nucleic acid is 80% or more (e.g., 85% or more, 90% or more, 95% or more, 97% or more, 98% or more, 99% or more, or 100%) over 17-25 contiguous nucleotides. In some cases, the percent complementarity between the guide sequence and the target site of the target nucleic acid is 90% or more (e.g., 95% or more, 97% or more, 98% or more, 99% or more, or 100%) over 17-25 contiguous nucleotides. In some cases, the percent complementarity between the guide sequence and the target site of the target nucleic acid is 100% over 17-25 contiguous nucleotides.

In some cases, the percent complementarity between the guide sequence and the target site of the target nucleic acid is 60% or more (e.g., 70% or more, 75% or more, 80% or more, 85% or more, 90% or more, 95% or more, 97% or more, 98% or more, 99% or more, or 100%) over 19-25 contiguous nucleotides. In some cases, the percent complementarity between the guide sequence and the target site of the target nucleic acid is 80% or more (e.g., 85% or more, 90% or more, 95% or more, 97% or more, 98% or more, 99% or more, or 100%) over 19-25 contiguous nucleotides. In some cases, the percent complementarity between the guide sequence and the target site of the target nucleic acid is 90% or more (e.g., 95% or more, 97% or more, 98% or more, 99% or more, or 100%) over 19-25 contiguous nucleotides. In some cases, the percent complementarity between the guide sequence and the target site of the target nucleic acid is 100% over 19-25 contiguous nucleotides.

In some cases, the guide sequence has a length in a range of from 17-30 nucleotides (nt) (e.g., from 17-25, 17-22, 17-20, 19-30, 19-25, 19-22, 19-20, 20-30, 20-25, or 20-22 nt). In some cases, the guide sequence has a length in a range of from 17-25 nucleotides (nt) (e.g., from 17-22, 17-20, 19-25, 19-22, 19-20, 20-25, or 20-22 nt). In some cases, the guide sequence has a length of 17 or more nt (e.g., 18 or more, 19 or more, 20 or more, 21 or more, or 22 or more nt; 19 nt, 20 nt, 21 nt, 22 nt, 23 nt, 24 nt, 25 nt, etc.). In some cases, the guide sequence has a length of 19 or more nt (e.g., 20 or more, 21 or more, or 22 or more nt; 19 nt, 20 nt, 21 nt, 22 nt, 23 nt, 24 nt, 25 nt, etc.). In some cases the guide sequence has a length of 17 nt. In some cases the guide sequence has a length of 18 nt. In some cases the guide sequence has a length of 19 nt. In some cases the guide sequence has a length of 20 nt. In some cases the guide sequence has a length of 21 nt. In some cases the guide sequence has a length of 22 nt. In some cases the guide sequence has a length of 23 nt.

Protein-Binding Segment of a CRISPR/Cas Guide RNA

The protein-binding segment of a subject CRISPR/Cas guide RNA interacts with a Class 2 CRISPR/Cas effector protein. The CRISPR/Cas guide RNA guides the bound Class 2 CRISPR/Cas effector protein to a specific nucleotide sequence within target nucleic acid via the above mentioned guide sequence. The protein-binding segment of a CRISPR/Cas guide RNA comprises two stretches of nucleotides that are complementary to one another and hybridize to form a double stranded RNA duplex (dsRNA duplex). Thus, the protein-binding segment includes a dsRNA duplex.

In some cases, the dsRNA duplex region includes a range of from 5-25 base pairs (bp) (e.g., from 5-22, 5-20, 5-18, 5-15, 5-12, 5-10, 5-8, 8-25, 8-22, 8-18, 8-15, 8-12, 12-25, 12-22, 12-18, 12-15, 13-25, 13-22, 13-18, 13-15, 14-25, 14-22, 14-18, 14-15, 15-25, 15-22, 15-18, 17-25, 17-22, or 17-18 bp, e.g., 5 bp, 6 bp, 7 bp, 8 bp, 9 bp, 10 bp, etc.). In some cases, the dsRNA duplex region includes a range of from 6-15 base pairs (bp) (e.g., from 6-12, 6-10, or 6-8 bp, e.g., 6 bp, 7 bp, 8 bp, 9 bp, 10 bp, etc.). In some cases, the duplex region includes 5 or more bp (e.g., 6 or more, 7 or more, or 8 or more bp). In some cases, the duplex region includes 6 or more bp (e.g., 7 or more, or 8 or more bp). In some cases, not all nucleotides of the duplex region are paired, and therefore the duplex forming region can include a bulge. The term "bulge" herein is used to mean a stretch of nucleotides (which can be one nucleotide or multiple nucleotides) that do not contribute to a double stranded duplex, but which are surround 5' and 3' by nucleotides that do contribute, and as such a bulge is considered part of the duplex region. In some cases, the dsRNA includes 1 or more bulges (e.g., 2 or more, 3 or more, 4 or more bulges). In some cases, the dsRNA duplex includes 2 or more bulges (e.g., 3 or more, 4 or more bulges). In some cases, the dsRNA duplex includes 1-5 bulges (e.g., 1-4, 1-3, 2-5, 2-4, or 2-3 bulges).

Thus, in some cases, the stretches of nucleotides that hybridize to one another to form the dsRNA duplex have 70%-100% complementarity (e.g., 75%-100%, 80%-10%, 85%-100%, 90%-100%, 95%-100% complementarity) with one another. In some cases, the stretches of nucleotides that hybridize to one another to form the dsRNA duplex have 70%-100% complementarity (e.g., 75%-100%, 80%-10%, 85%-100%, 90%-100%, 95%-100% complementarity) with one another. In some cases, the stretches of nucleotides that hybridize to one another to form the dsRNA duplex have 85%-100% complementarity (e.g., 90%-100%, 95%-100% complementarity) with one another. In some cases, the stretches of nucleotides that hybridize to one another to form the dsRNA duplex have 70%-95% complementarity (e.g., 75%-95%, 80%-95%, 85%-95%, 90%-95% complementarity) with one another.

In other words, in some embodiments, the dsRNA duplex includes two stretches of nucleotides that have 70%-100% complementarity (e.g., 75%-100%. 80%-10%, 85%-100%, 90%-100%, 95%-100% complementarity) with one another. In some cases, the dsRNA duplex includes two stretches of nucleotides that have 85%-100% complementarity (e.g., 90%-100%, 95%-100% complementarity) with one another. In some cases, the dsRNA duplex includes two stretches of nucleotides that have 70%-95% complementarity (e.g., 75%-95%, 80%-95%, 85%-95%, 90%-95% complementarity) with one another.

The duplex region of a subject CRISPR/Cas guide RNA can include one or more (1, 2, 3, 4, 5, etc) mutations relative to a naturally occurring duplex region. For example, in some cases a base pair can be maintained while the nucleotides contributing to the base pair from each segment can be different. In some cases, the duplex region of a subject CRISPR/Cas guide RNA includes more paired bases, less paired bases, a smaller bulge, a larger bulge, fewer bulges, more bulges, or any convenient combination thereof, as compared to a naturally occurring duplex region (of a naturally occurring CRISPR/Cas guide RNA).

Examples of various Cas9 guide RNAs and cpf1 guide RNAs can be found in the art, and in some cases variations similar to those introduced into these guide RNAs can also be introduced into CRISPR/Cas guide RNAs of the present disclosure (e.g., mutations to the dsRNA duplex region, extension of the 5' or 3' end for added stability for to provide for interaction with another protein, and the like). For example, see Jinek et al., Science. 2012 Aug. 17; 337(6096):816-21; Chylinski et al., RNA Biol. 2013 May; 10(5):726-37; Ma et al., Biomed Res Int. 2013; 2013:270805; Hou et al., Proc Natl Acad Sci USA. 2013 Sep. 24; 110(39):15644-9; Jinck et al., Elife. 2013; 2:e00471; Pattanayak et al., Nat Biotechnol. 2013 September; 31(9):839-43; Qi et al, Cell. 2013 Feb. 28; 152(5):1173-83; Wang et al., Cell. 2013 May 9; 153(4):910-8; Auer et al., Genome Res. 2013 Oct. 31; Chen et al., Nucleic Acids Res. 2013 Nov. 1; 41(20):e19; Cheng et al., Cell Res. 2013 October; 23(10):1163-71; Cho et al., Genetics. 2013 November; 195(3):1177-80; DiCarlo et al., Nucleic Acids Res. 2013 April; 41(7):4336-43; Dickinson et al., Nat Methods. 2013 October; 10(10):1028-34; Ebina et al., Sci Rep. 2013; 3:2510; Fujii et. al, Nucleic Acids Res. 2013 Nov. 1; 41(20):e187; Hu et al., Cell Res. 2013 November; 23(11):1322-5; Jiang et al., Nucleic Acids Res. 2013 Nov. 1; 41(20):e188; Larson et al., Nat Protoc. 2013 November; 8(11):2180-96; Mali et. at., Nat Methods. 2013 October; 10(10):957-63; Nakayama et al., Genesis. 2013 December; 51(12):835-43; Ran et al., Nat Protoc. 2013 November; 8(11):2281-308; Ran et al., Cell. 2013 Sep. 12; 154(6):1380-9; Upadhyay et al., G3 (Bethesda). 2013 Dec. 9; 3(12):2233-8; Walsh et al., Proc Natl Acad Sci USA. 2013 Sep. 24; 110(39):15514-5; Xie et al., Mol Plant. 2013 Oct. 9; Yang et al., Cell. 2013 Sep. 12; 154(6):1370-9; Briner et al., Mol Cell. 2014 Oct. 23; 56(2):333-9; and U.S. patents and patent applications: U.S. Pat. Nos. 8,906,616; 8,895,308; 8,889,418; 8,889,356; 8,871,445; 8,865,406; 8,795,965; 8,771,945; 8,697,359; 20140068797; 20140170753; 20140179006; 20140179770; 20140186843; 20140186919; 20140186958; 20140189896; 20140227787; 20140234972; 20140242664; 20140242699; 20140242700; 20140242702; 20140248702; 20140256046; 20140273037; 20140273226; 20140273230; 20140273231; 20140273232; 20140273233; 20140273234; 20140273235; 20140287938; 20140295556; 20140295557; 20140298547; 20140304853; 20140309487; 20140310828; 20140310830; 20140315985; 20140335063; 20140335620; 20140342456; 20140342457; 20140342458; 20140349400; 20140349405; 20140356867; 20140356956; 20140356958; 20140356959; 20140357523; 20140357530; 20140364333; and 20140377868; all of which are hereby incorporated by reference in their entirety.

A CRISPR/Cas guide RNA comprises both the guide sequence and two stretches ("duplex-forming segments") of nucleotides that hybridize to form the dsRNA duplex of the protein-binding segment. The particular sequence of a given CRTSPR/Cas guide RNA can be characteristic of the species in which the crRNA is found. Suitable protein binding regions (repeat sequences) of CRISPR/Cas guide RNAs include, but are not limited to, those provided herein.

Single-Molecule Hybrid CRISP/Cas Guide RNA/Tranc RNA

A CRISPR/Cas guide RNA can in some cases comprise a tranc RNA (also referred to as a "scout" RNA). In some cases, a CRISPR/Cas guide RNA is a single-molecule guide RNA comprising: i) a CRISPR/Cas guide RNA; and ii) a tranc RNA. In some cases, a CRISPR/Cas guide RNA comprises, in order from 5' to 3': i) a CRISPR/Cas guide RNA; and ii) a tranc RNA. In some cases, the CRISPR/Cas guide RNA is linked directly to the tranc RNA. In some cases, the CRISPR/Cas guide RNA is linked to the tranc RNA through a nucleotide linker (e.g., a polynucleotide linker). A nucleotide linker can comprise from 1 to 30 nucleotides (e.g., from 1 to 5 nucleotides, from 5 to 10 nucleotides, from 10 to 15 nucleotides, from 15 to 20 nucleotides, from 20 to 25 nucleotides, or from 25 to 30 nucleotides). In some cases, the CRISPR/Cas guide RNA is linked to the tranc RNA through a non-nucleotide linkage. For example, in some cases, a CRISPR/Cas guide RNA is linked to the tranc RNA through a thioether linker or a triazole linker.

Example Guide RNA Sequences

Repeat sequences (non-guide sequence portion of a CRISPR/Cas guide RNA) of crRNAs for naturally existing Class 2 CRISPR/Cas effector proteins (e.g., see FIG. 1) are shown in Table 1.

TABLE 1 crRNA repeat sequences for CRISPR/Cas guide RNAs

| Protein | crRNA repeat | SEQ ID NO: |
|---|---|---|
| Cas12c (C2c3) | | |
| Cas12c_1 | AGCAGGAUUCAGGUUGGGUUUGAGG | 172 |
| Cas12c_1 (processsed) | AUUCAGGUUGGGUUUGAGG | 173 |
| Cas12c_2 | CCCAUAAUUGAUAGGAUCUAUGAGGU | 174 |
| Cas12c_3 | AGAAUUACUGAUGUUGUGAUGAAGGC | 175 |
| Cas12c_4 | GCUAGUAAUGAGAGGAUGUUGAAG | 176 |
| Cas12c_5 | GUUAGAAAUGAGAGGAUAUUGAAGG | 177 |
| Cas12c_6 | CCCAUUAUUGGAAGGGUUUAUAAGG | 178 |
| Cas12c_7 | AGCAGGAUUCAGGUUGGGUUUGAGG | 179 |
| Cas12c_8 | GAAUUACUGAUGUUGUGAUGAAGGC | 180 |
| CasY | | |
| CasY1 | CUCCGAAAGUAUCGGGGAUAAAGGC | 181 |
| CasY2 | CACCGAAAUUUGGAGAGGAUAAGGC | 182 |
| CasY3 | CUCCGAAUUAUCGGGAGGAUAAGGC | 183 |
| CasY4 | CCCCGAAUAUAGGGGACAAAAAGGC | 184 |
| CasY5 | GUCUAGACAUACAGGUGGAAAGGUGAGAGUAAAGAC | 185 |
| CasY6 | GUCUAGACAUACAGGUGGAAAGGUGAGAGUAAAGAC | 186 |
| CasY7 | CUCCGUGAAUACGUGGGGUAAAGGC | 187 |
| CasY18 | CUCCGAAAGUAUCGGGGAUAAAGGC | 188 |
| CasY9 | AAUCGAGGGUUAGUAACCAAAAGGC | 189 |
| CasY10 | CCCCGAAGAUUAGAGGGAAAAAGGC | 190 |
| CasY11 | CGCCGAAAGUUAGGAACUAAAAGGC | 191 |
| CasY12 | UCGAAGGUUAGGAACCAAAAGGC | 192 |
| CasY14 | CCCCGAAACUACAGGGGAUAAAGGC | 193 |
| CasY15 | ACCCGUAAAGCAGAGCGAUGAAGGC | 194 |
| CasY16 | CCUCGGAUGUAACGGGGAUAAAGGC | 195 |
| CasZ | | |
| Za.1 | GTTGCATTCCTTCATTCGTCTATTCGGGTTCTGCAAC | 196 |
| Za.2 | GTTGCATTCCTTCATTCGTCTATCCGGGTTCTGCAAG | 197 |
| Za.3 | GTTGCAGAACCCGAATAGACGAATGAAGGAATGCAAC | 198 |
| Za.4 | CTATCATATTCAGAACAAAGGGATTAAGGAATGCAAC | 199 |

TABLE 1-continued crRNA repeat sequences for CRISPR/Cas guide RNAs

| Protein | crRNA repeat | SEQ ID NO: |
|---|---|---|
| Za.5 | CTTTCATACTCAGAACAAAGGGATTAAGGAATGCAAC | 200 |
| Za.6 | GTCTACAACTCATTGATAGAAATCAATGAGTTAGACA | 201 |
| Za.7 | GTTATAAAGGCGGGGATCGCGACCGAGCGATTGAAAG | 202 |
| Zb.1 | GTTGCATTCCTTAATTCATTTTCTCAATATCGGAAAC | 203 |
| Zb.2 | GTTGCAGAAATAGAATAAAGGAATTAAGGAATGCAAC | 204 |
| Zb.3 | CTTTCATACTCAGAACAAAGGGATTAAGGAATGCAAC | 200 |
| Zb.4 | ATTTCATACTCAGAACAAAGGGATTAAGGAATGCAAC | 206 |
| Zb.5 | GTTTCAGCGCACGAATTAACGAGATGAGAGATGCAACT | 207 |
| Zb.6 | CTTGCAGAAGCTGAATAGACGAATCAAGGAATGCAAC | 208 |
| Zb.7 | CACTTGCAGGCCTTGAATAGAGGAGTTAAGGAATGCAAC | 209 |
| Zb.8 | GTCTCCATGACTGAAAAGTCGTGGCCGAATTGAAAC | 210 |
| Zb.9 | GTTGCAGCGCCCGAACTGACGAGACGAGAGATGCAAC | 211 |
| Zb.10 | GTTGCGCGAATAGAATAAAGGAATTAAGGAATGCAAC | 212 |
| Zb.11 | AGTTGCATTCCTTAATCCCTCTGTTCAGTTTGTGCAAT | 213 |
| Zc.1 | GTTGCATTCCTAGTTTCTCTAATTAGCACTGTGCAAC | 214 |
| Zc.2 | GTTGCGGCGCGCGAATAAACGAGACTAGGAATGCAAC | 215 |
| Zc.3 | ACTAGTTGCATTCCTTAATCCCTTTGTTCTGAATATGCTAG | 216 |
| Zc.4 | CTTTCATATTCAGAACAAAGGGATTAAGGAATGCAAC | 217 |
| Zc.5 | GTTGCAGTCCTTAACCCCTAGTTTCTGAATATGAAAGAT | 218 |
| Zc.6 | GTTGCAGCCCCCGAACTAACGAGATGAGAGATGCAAC | 219 |
| Zc.7 | CTTGCAGAACAATCATATATGACTAATCAGACTGCAAC | 220 |
| Zd.1 | GTTGCACTCACCGGTGCTCACGACGTAGGGATGCAAC | 221 |
| Zd.2 | GTCCCTACTCGCTAGGGAAACTAATTGAATGGAAAC | 222 |
| Ze.1 | GTTGCATTCGGGTGCAAAACAGGGAGTAGAGTGTAAC | 223 |
| Ze.2 | CTTCCAAACTCGAGCCAGTGGGGAGAGAAGTGGCA | 224 |
| Ze.3 | CCTGTAGACCGGTCTCATTCTGAGAGGGGTATGCAACT | 225 |
| Ze.4 | GTCTCGAGACCCTACAGATTTTGGAGAGGGGTGGGAC | 226 |
| Ze.4b | GTCCCACCCCTCTCCAAAATCTGTAGGGTCTCGAGAC | 227 |
| Zf.1 | GTAGCAGGACTCTCCTCGAGAGAAACAGGGGTATGCT | 228 |
| Zf.2 | GTACAATACCTCTCCTTTAAGAGAGGGAGGGGTACGCTAC | 229 |
| Zf.3 | CCCCCTCGTTTCCTTCAGGGGATTCCTTTCC | 230 |
| Zg.1 | GGTTCCCCCGGGCGCGGGTGGGGTGGCG | 231 |
| Zg.2 | GGCTGCTCCGGGTGCGCGTGGAGCGAGG | 232 |
| Zh.1 | GTTTTATACCCTTTAGAATTTAAACTGTCTAAAAG | 233 |
| Zi.1 | ATTGCACCGGCCAACGCAAATCTGATTGATGGACAC | 234 |
| Zi.2 | GCCGCAGCGGCCGACGCGGCCCTGATCGATGGACAC | 235 |
| Zj.1 | GTCGAAATGCCCGCGCGGGGGCGTCGTACCCGCGAC | 236 |

TABLE 1-continued crRNA repeat sequences for CRISPR/Cas guide RNAs

| Protein | crRNA repeat | SEQ ID NO: |
|---|---|---|
| Zk.1 | GGCTAGCCCGTGCGCGCAGGGACGAGTGG | 237 |
| Zk.2 | GCCCGTGCGCGCAGGGACGAGTGG | 238 |
| Zk.3 | GTTGCAGCGGCCGACGGAGCGCGAGCGTGGATGCCAC | 239 |
| Zk.4 | CCATCGCCCCGCGCGCACGTGGATGAGCC | 240 |
| Zl.1 | CTTTAGACTTCTCCGGAAGTCGAATTAATGGAAAC | 241 |
| Zl.2 | GGGCGCCCCGCGCGAGCGGGGGTTGAAG | 242 |
| Za.8 | CTTGCAGAACCCGGATAGACGAATGAAGGAATGCAAC | 368 |
| Zb.12 | CTTGCAGGCCTTGAATAGAGGAGTTAAGGAATGCAAC | 370 |
| Zb.13 | GTTGCACAGTGCTAATTAGAGAAACTAGGAATGCAAC | 371 |
| Zb.14 | CTAGCATATTCAGAACAAAGGGATTAAGGAATGCAAC | 372 |
| Zb.15 | CTTTCATATTCAGAAACTAGGGGTTAAGGACTGCAAC | 373 |
| Zc.8 | GTTGCATCCCTACGTCGTGAGCACCGGTGAGTGCAAC | 374 |
| Ze.5 | GGAAAGGAATCCCCTGAAGGAAACGAGGGGG | 375 |
| Zg.3 | GTGTCCATCAATCAGATTTGCGTTGGCCGGTGCAAT | 376 |
| Zb.16 | GTTTCAGCGCACGAATTAACGAGATGAGAGATGCAAC | 377 |
| Zj.2 | CTTTTAGACAGTTTAAATTCTAAAGGGTATAAAAC | 378 | i. Cas12c (C2c3) Guide RNA Sequences

In some cases, a subject CRISPR/Cas guide RNA comprises (e.g., in addition to a guide sequence, e.g., as part of the protein-binding region) a crRNA sequence of Table 1 or Table 5. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a crRNA sequence of Table 1 or Table 5. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a crRNA sequence of Table 1 or Table 5. In some cases, a subject CRISPR/Cas guide RNA comprises a nucleotide sequence having 90% or more identity (e.g., 93% or more, 95% or more, 97% or more, 98% or more, or 100% identity) with a crRNA sequence of Table 1 or Table 5.

In some cases, a subject CRISPR/Cas guide RNA comprises (e.g., in addition to a guide sequence, e.g., as part of the protein-binding region) a Cas12c_1 crRNA sequence of Table 1. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a Cas12c_1 crRNA sequence of Table 1. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a Cas12c_1 crRNA sequence of Table 1. In some cases, a subject CRISPR/Cas guide RNA comprises a nucleotide sequence having 90% or more identity (e.g., 93% or more, 95% or more, 97% or more, 98% or more, or 100% identity) with a Cas12c_1 crRNA sequence of Table 1.

In some cases, a subject CRISPR/Cas guide RNA comprises (e.g., in addition to a guide sequence, e.g., as part of the protein-binding region) a Cas12c_2 crRNA sequence of Table 1. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a Cas12c_2 crRNA sequence of Table 1. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a Cas12c_2 crRNA sequence of Table 1. In some cases, a subject CRISPR/Cas guide RNA comprises a nucleotide sequence having 90% or more identity (e.g., 93% or more, 95% or more, 97% or more, 98% or more, or 100% identity) with a Cas12c_2 crRNA sequence of Table 1.

In some cases, a subject CRISPR/Cas guide RNA comprises (e.g., in addition to a guide sequence, e.g., as part of the protein-binding region) a Cas12c_7 crRNA sequence of Table 1. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a Cas12c_7 crRNA sequence of Table 1. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a Cas12c_7 crRNA sequence of Table 1. In some cases, a subject CRISPR/Cas guide RNA comprises a nucleotide sequence having 90% or more identity (e.g., 93% or more, 95% or more, 97% or more, 98% or more, or 100% identity) with a Cas12c_7 crRNA sequence of Table 1.

In some cases, a subject CRISPR/Cas guide RNA comprises (e.g., in addition to a guide sequence, e.g., as part of the protein-binding region) a Cas12c_8 crRNA sequence of Table 1. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a Cas12c_8 crRNA sequence of Table 1. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a Cas12c_8 crRNA sequence of Table 1. In some cases, a subject CRISPR/Cas guide RNA comprises a nucleotide sequence having 90% or more identity (e.g., 93% or more, 95% or more, 97% or more, 98% or more, or 100% identity) with a Cas12c_8 crRNA sequence of Table 1.

In some cases, a subject CRISPR/Cas guide RNA comprises (e.g., in addition to a guide sequence, e.g., as part of the protein-binding region) a Cas12c_1, Cas12c_2, Cas12c_7, or Cas12c_8 crRNA sequence of Table 1. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a Cas12c_1, Cas12c_2, Cas12c_7, or Cas12c_8 crRNA sequence of Table 1. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a Cas12c_1, Cas12c_2, Cas12c_7, or Cas12c_8 crRNA sequence of Table 1. In some cases, a subject CRISPR/Cas guide RNA comprises a nucleotide sequence having 90% or more identity (e.g., 93% or more, 95% or more, 97% or more, 98% or more, or 100% identity) with a Cas12c_1, Cas12c_2, Cas12c_7, or Cas12c_8 crRNA sequence of Table 1.

In some cases, a subject CRISPR/Cas guide RNA comprises (e.g., in addition to a guide sequence, e.g., as part of the protein-binding region) a Cas12c_3 crRNA sequence of Table 1. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a Cas12c_3 crRNA sequence of Table 1. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a Cas12c_3 crRNA sequence of Table 1. In some cases, a subject CRISPR/Cas guide RNA comprises a nucleotide sequence having 90% or more identity (e.g., 93% or more, 95% or more, 97% or more, 98% or more, or 100% identity) with a Cas12c_3 crRNA sequence of Table 1.

In some cases, a subject CRISPR/Cas guide RNA comprises (e.g., in addition to a guide sequence, e.g., as part of the protein-binding region) a Cas12c_4 crRNA sequence of Table 1. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a Cas12c_4 crRNA sequence of Table 1. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a Cas12c_4 crRNA sequence of Table 1. In some cases, a subject CRISPR/Cas guide RNA comprises a nucleotide sequence having 90% or more identity (e.g., 93% or more, 95% or more, 97% or more, 98% or more, or 100% identity) with a Cas12c_4 crRNA sequence of Table 1.

In some cases, a subject CRISPR/Cas guide RNA comprises (e.g., in addition to a guide sequence, e.g., as part of the protein-binding region) a Cas12c_5 crRNA sequence of Table 1. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a Cas12c_5 crRNA sequence of Table 1. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a Cas12c_5 crRNA sequence of Table 1. In some cases, a subject CRISPR/Cas guide RNA comprises a nucleotide sequence having 90% or more identity (e.g., 93% or more, 95% or more, 97% or more, 98% or more, or 100% identity) with a Cas12c_5 crRNA sequence of Table 1.

In some cases, a subject CRISPR/Cas guide RNA comprises (e.g., in addition to a guide sequence, e.g., as part of the protein-binding region) a Cas12c_6 crRNA sequence of Table 1. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a Cas12c_6 crRNA sequence of Table 1. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a Cas12c_6 crRNA sequence of Table 1. In some cases, a subject CRISPR/Cas guide RNA comprises a nucleotide sequence having 90% or more identity (e.g., 93% or more, 95% or more, 97% or more, 98% or more, or 100% identity) with a Cas12c_6 crRNA sequence of Table 1.

In some cases, a subject CRISPR/Cas guide RNA comprises (e.g., in addition to a guide sequence, e.g., as part of the protein-binding region) a Cas12c_3, Cas12c_4, Cas12c_5, or Cas12c_6 crRNA sequence of Table 1. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a Cas12c_3, Cas12c_4, Cas12c_5, or Cas12c_6 crRNA sequence of Table 1. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a Cas12c_3, Cas12c_4, Cas12c_5, or Cas12c_6 crRNA sequence of Table 1. In some cases, a subject CRISPR/Cas guide RNA comprises a nucleotide sequence having 90% or more identity (e.g., 93% or more, 95% or more, 97% or more, 98% or more, or 100% identity) with a Cas12c_3, Cas12c_4, Cas12c_5, or Cas12c_6 crRNA sequence of Table 1.

ii. CasY Guide RNA Sequences

The repeat sequences (non-guide sequence portion of example CasY guide RNAs) depicted in Table 1 are from natural loci. In some cases, a subject CRISPR/Cas guide RNA comprises (e.g., in addition to a guide sequence) the CasY1 crRNA sequence of Table 1. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with the CasY1 crRNA sequence of Table 1. In some cases, a subject CRISPR/Cas guide RNA comprises a nucleotide sequence having 90% or more identity (e.g., 93% or more, 95% or more, 97% or more, 98% or more, or 100% identity) the CasY1 crRNA sequence of Table 1.

In some cases, a subject CRISPR/Cas guide RNA comprises (e.g., in addition to a guide sequence) the CasY2 crRNA sequence of Table 1. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with the CasY2 crRNA sequence of Table 1. In some cases, a subject CRISPR/Cas guide RNA comprises a nucleotide sequence having 90% or more identity (e.g., 93% or more, 95% or more, 97% or more, 98% or more, or 100% identity) with the CasY2 crRNA sequence of Table 1.

In some cases, a subject CRISPR/Cas guide RNA comprises (e.g., in addition to a guide sequence) the CasY3 crRNA sequence of Table 1. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with the CasY3 crRNA sequence of Table 1. In some cases, a subject CRISPR/Cas guide RNA comprises a nucleotide sequence having 90% or more identity (e.g., 93% or more, 95% or more, 97% or more, 98% or more, or 100% identity) with the CasY3 crRNA sequence of Table 1.

In some cases, a subject CRISPR/Cas guide RNA comprises (e.g., in addition to a guide sequence) the CasY4 crRNA sequence of Table 1. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with the CasY4 crRNA sequence of Table 1. In some cases, a subject CRISPR/Cas guide RNA comprises a nucleotide sequence having 90% or more identity (e.g., 93% or more, 95% or more, 97% or more, 98% or more, or 100% identity) with the CasY4 crRNA sequence of Table 1.

In some cases, a subject CRISPR/Cas guide RNA comprises (e.g., in addition to a guide sequence) the CasY5 crRNA sequence of Table 1. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with the CasY5 crRNA sequence of Table 1. In some cases, a subject CRISPR/Cas guide RNA comprises a nucleotide sequence having 90% or more identity (e.g., 93% or more, 95% or more, 97% or more, 98% or more, or 100% identity) with the CasY5 crRNA sequence of Table 1.

In some cases, a subject CRISPR/Cas guide RNA comprises (e.g., in addition to a guide sequence) the CasY6 crRNA sequence of Table 1. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with the CasY6 crRNA sequence of Table 1. In some cases, a subject CRISPR/Cas guide RNA comprises a nucleotide sequence having 90% or more identity (e.g., 93% or more, 95% or more, 97% or more, 98% or more, or 100% identity) with the CasY6 crRNA sequence of Table 1.

In some cases, a subject CRISPR/Cas guide RNA comprises (e.g., in addition to a guide sequence) the CasY18 crRNA sequence of Table 1. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with the CasY18 crRNA sequence of Table 1. In some cases, a subject CRISPR/Cas guide RNA comprises a nucleotide sequence having 90% or more identity (e.g., 93% or more, 95% or more, 97% or more, 98% or more, or 100% identity) with the CasY18 crRNA sequence of Table 1.

In some cases, a subject CRISPR/Cas guide RNA comprises (e.g., in addition to a guide sequence) a CasY crRNA sequence of Table 1. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a CasY crRNA sequence of Table 1. In some cases, a subject CRISPR/Cas guide RNA comprises a nucleotide sequence having 90% or more identity (e.g., 93% or more, 95% or more, 97% or more, 98% or more, or 100% identity) with a CasY crRNA sequence of Table 1.

In some cases, a subject CRISPR/Cas guide RNA comprises (e.g., in addition to a guide sequence) a CasY1, CasY2, CasY3, CasY4, CasY5, or CasY18 crRNA sequence of Table 1. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with the CasY1, CasY2, CasY3, CasY4, CasY5, or CasY18 crRNA sequence of Table 1. In some cases, a subject CRISPR/Cas guide RNA comprises a nucleotide sequence having 90% or more identity (e.g., 93% or more, 95% or more, 97% or more, 98% or more, or 100% identity) with the CasY1, CasY2, CasY3, CasY4, CasY5, or CasY18 crRNA sequence of Table 1.

In some cases, a subject CRISPR/Cas guide RNA comprises (e.g., in addition to a guide sequence) a CasY9, CasY10, CasY11, CasY12, CasY14, CasY15, or CasY16 crRNA sequence of Table 1. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with the CasY9, CasY10, CasY11, CasY12, CasY14, CasY15, or CasY16 crRNA sequence of Table 1. In some cases, a subject CRISPR/Cas guide RNA comprises a nucleotide sequence having 90% or more identity (e.g., 93% or more, 95% or more, 97% or more, 98% or more, or 100% identity) with the CasY9, CasY10, CasY11, CasY12, CasY14, CasY15, or CasY16 crRNA sequence of Table 1.

iii. CasZ Guide RNA Sequences

Repeat sequences (non-guide sequence portion of a CasZ guide RNA) of crRNAs for naturally existing CasZ proteins (e.g., see FIG. 1 or FIG. 29) are shown in Table 1 or Table 5. In some cases, a subject CRISPR/Cas guide RNA comprises (e.g., in addition to a guide sequence, e.g., as part of the protein-binding region) a CasZ crRNA sequence of Table 1 or Table 5. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a CasZ crRNA sequence of Table 1 or Table 5. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a CasZ crRNA sequence of Table 1 or Table 5. In some cases, a subject CRISPR/Cas guide RNA comprises a nucleotide sequence having 90% or more identity (e.g., 93% or more, 95% or more, 97% or more, 98% or more, or 100% identity) with a CasZ crRNA sequence of Table 1 or Table 5.

In some cases, a subject CRISPR/Cas guide RNA comprises (e.g., in addition to a guide sequence, e.g., as part of the protein-binding region) a CasZa, CasZb, CasZc, CasZd, CasZe, CasZf, CasZg, CasZh, or CasZi crRNA sequence of Table 1 or Table 5. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a CasZa, CasZb, CasZc, CasZd, CasZe, CasZf, CasZg, CasZh, or CasZi crRNA sequence of Table 1 or Table 5. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a CasZa, CasZb, CasZc, CasZd, CasZe, CasZf, CasZg, CasZh, or CasZi crRNA sequence of Table 1 or Table 5. In some cases, a subject CRISPR/Cas guide RNA comprises a nucleotide sequence having 90% or more identity (e.g., 93% or more, 95% or more, 97% or more, 98% or more, or 100% identity) with a CasZa, CasZb, CasZc, CasZd, CasZe, CasZf, CasZg, CasZh, or CasZi crRNA sequence of Table 1 or Table 5.

In some cases, a subject CRISPR/Cas guide RNA comprises (e.g., in addition to a guide sequence, e.g., as part of the protein-binding region) a CasZa crRNA sequence of Table 1 or Table 5. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a CasZa crRNA sequence of Table 1 or Table 5. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a CasZa crRNA sequence of Table 1 or Table 5. In some cases, a subject CRISPR/Cas guide RNA comprises a nucleotide sequence having 90% or more identity (e.g., 93% or more, 95% or more, 97% or more, 98% or more, or 100% identity) with a CasZa crRNA sequence of Table 1 or Table 5.

In some cases, a subject CRISPR/Cas guide RNA comprises (e.g., in addition to a guide sequence, e.g., as part of the protein-binding region) a CasZb crRNA sequence of Table 1 or Table 5. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a CasZb crRNA sequence of Table 1 or Table 5. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a CasZb crRNA sequence of Table 1 or Table 5. In some cases, a subject CRISPR/Cas guide RNA comprises a nucleotide sequence having 90% or more identity (e.g., 93% or more, 95% or more, 97% or more, 98% or more, or 100% identity) with a CasZb crRNA sequence of Table 1 or Table 5.

In some cases, a subject CRISPR/Cas guide RNA comprises (e.g., in addition to a guide sequence, e.g., as part of the protein-binding region) a CasZc crRNA sequence of Table 1 or Table 5. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a CasZc crRNA sequence of Table 1 or Table 5. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a CasZc crRNA sequence of Table 1 or Table 5. In some cases, a subject CRISPR/Cas guide RNA comprises a nucleotide sequence having 90% or more identity (e.g., 93% or more, 95% or more, 97% or more, 98% or more, or 100% identity) with a CasZc crRNA sequence of Table 1 or Table 5.

In some cases, a subject CRISPR/Cas guide RNA comprises (e.g., in addition to a guide sequence, e.g., as part of the protein-binding region) a CasZd crRNA sequence of Table 1 or Table 5. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a CasZd crRNA sequence of Table 1 or Table 5. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a CasZd crRNA sequence of Table 1 or Table 5. In some cases, a subject CRISPR/Cas guide RNA comprises a nucleotide sequence having 90% or more identity (e.g., 93% or more, 95% or more, 97% or more, 98% or more, or 100% identity) with a CasZd crRNA sequence of Table 1 or Table 5.

In some cases, a subject CRISPR/Cas guide RNA comprises (e.g., in addition to a guide sequence, e.g., as part of the protein-binding region) a CasZe crRNA sequence of Table 1 or Table 5. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a CasZe crRNA sequence of Table 1 or Table 5. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a CasZe crRNA sequence of Table 1 or Table 5. In some cases, a subject CRISPR/Cas guide RNA comprises a nucleotide sequence having 90% or more identity (e.g., 93% or more, 95% or more, 97% or more, 98% or more, or 100% identity) with a CasZe crRNA sequence of Table 1 or Table 5.

In some cases, a subject CRISPR/Cas guide RNA comprises (e.g., in addition to a guide sequence, e.g., as part of the protein-binding region) a CasZf crRNA sequence of Table 1 or Table 5. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a CasZf crRNA sequence of Table 1 or Table 5. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a CasZf crRNA sequence of Table 1 or Table 5. In some cases, a subject CRISPR/Cas guide RNA comprises a nucleotide sequence having 90% or more identity (e.g., 93% or more, 95% or more, 97% or more, 98% or more, or 100% identity) with a CasZf crRNA sequence of Table 1 or Table 5.

In some cases, a subject CRISPR/Cas guide RNA comprises (e.g., in addition to a guide sequence, e.g., as part of the protein-binding region) a CasZg crRNA sequence of Table 1 or Table 5. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a CasZg crRNA sequence of Table 1 or Table 5. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a CasZg crRNA sequence of Table 1 or Table 5. In some cases, a subject CRISPR/Cas guide RNA comprises a nucleotide sequence having 90% or more identity (e.g., 93% or more, 95% or more, 97% or more, 98% or more, or 100% identity) with a CasZg crRNA sequence of Table 1 or Table 5.

In some cases, a subject CRISPR/Cas guide RNA comprises (e.g., in addition to a guide sequence, e.g., as part of the protein-binding region) a CasZh crRNA sequence of Table 1 or Table 5. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a CasZh crRNA sequence of Table 1 or Table 5. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a CasZh crRNA sequence of Table 1 or Table 5. In some cases, a subject CRISPR/Cas guide RNA comprises a nucleotide sequence having 90% or more identity (e.g., 93% or more, 95% or more, 97% or more, 98% or more, or 100% identity) with a CasZh crRNA sequence of Table 1 or Table 5.

In some cases, a subject CRISPR/Cas guide RNA comprises (e.g., in addition to a guide sequence, e.g., as part of the protein-binding region) a CasZi crRNA sequence of Table 1 or Table 5. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a CasZi crRNA sequence of Table 1 or Table 5. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a CasZi crRNA sequence of Table 1 or Table 5. In some cases, a subject CRISPR/Cas guide RNA comprises a nucleotide sequence having 90% or more identity (e.g., 93% or more, 95% or more, 97% or more, 98% or more, or 100% identity) with a CasZi crRNA sequence of Table 1 or Table 5.

In some cases, a subject CRISPR/Cas guide RNA comprises (e.g., in addition to a guide sequence, e.g., as part of the protein-binding region) a CasZj crRNA sequence of Table 1 or Table 5. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a CasZj crRNA sequence of Table 1 or Table 5. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a CasZj crRNA sequence of Table 1 or Table 5. In some cases, a subject CRISPR/Cas guide RNA comprises a nucleotide sequence having 90% or more identity (e.g., 93% or more, 95% or more, 97% or more, 98% or more, or 100% identity) with a CasZj crRNA sequence of Table 1 or Table 5.

In some cases, a subject CRISPR/Cas guide RNA comprises (e.g., in addition to a guide sequence, e.g., as part of the protein-binding region) a CasZk crRNA sequence of Table 1 or Table 5. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a CasZk crRNA sequence of Table 1 or Table 5. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a CasZk crRNA sequence of Table 1 or Table 5. In some cases, a subject CRISPR/Cas guide RNA comprises a nucleotide sequence having 90% or more identity (e.g., 93% or more, 95% or more, 97% or more, 98% or more, or 100% identity) with a CasZk crRNA sequence of Table 1 or Table 5.

In some cases, a subject CRISPR/Cas guide RNA comprises (e.g., in addition to a guide sequence, e.g., as part of the protein-binding region) a CasZl crRNA sequence of Table 1 or Table 5. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a CasZl crRNA sequence of Table 1 or Table 5. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a CasZl crRNA sequence of Table 1 or Table 5. In some cases, a subject CRISPR/Cas guide RNA comprises a nucleotide sequence having 90% or more identity (e.g., 93% or more, 95% or more, 97% or more, 98% or more, or 100% identity) with a CasZl crRNA sequence of Table 1 or Table 5.

In some cases, a subject CRISPR/Cas guide RNA comprises (e.g., in addition to a guide sequence, e.g., as part of the protein-binding region) a CasZj, CasZk, or CasZl crRNA sequence of Table 1 or Table 5. In some cases, a subject CRISPR/Cas guide RNA comprises a nucleotide sequence having 70% or more identity (e.g., 75% or more, 80% or more, 85% or more, 90% or more, 93% or more, 95% or more, 97% or more, 98% or more, or 100% identity) with a CasZj, CasZk, or CasZl crRNA sequence of Table 1 or Table 5. In some cases, a subject CRISPR/Cas guide RNA comprises a nucleotide sequence having 80% or more identity (e.g., 85% or more, 90% or more, 93% or more, 95% or more, 97% or more, 98% or more, or 100% identity) with a CasZj, CasZk, or CasZl crRNA sequence of Table 1 or Table 5. In some cases, a subject CRISPR/Cas guide RNA comprises a nucleotide sequence having 90% or more identity (e.g., 93% or more, 95% or more, 97% or more, 98% or more, or 100% identity) with a CasZj, CasZk, or CasZl crRNA sequence of Table 1 or Table 5.

CRISPR/Cas Transactivating Noncoding RNA (trancRNA)

Compositions and methods of the present disclosure include a CRISPR/Cas transactivating noncoding RNA ("trancRNA"; also referred to herein as a "CRISPR/Cas trancRNA"). In some cases, a trancRNA forms a complex with a Class 2 CRISPR/Cas effector protein and a CRISPR/Cas guide RNA. A trancRNA can be identified as a highly transcribed RNA encoded by a nucleotide sequence present in a Class 2 CRISPR/Cas locus. The sequence encoding a CRISPR/Cas trancRNA is usually located adjacent to a Cas1-encoding sequence but on the opposite side of the Cas1-encoding sequence as the CRISPR array (the CRISPR repeats); or adjacent to the CRISPR array (repeat sequences) and between the array and a protein-coding sequence. Examples below demonstrate detection of CasY, CasZ, and Cas12c trancRNAs. In some cases, a CRISPR/Cas trancRNA co-immunoprecipitates (forms a complex with) with a Class 2 CRISPR/Cas effector protein. In some cases, the presence of a CRISPR/Cas trancRNA is required for function of the system. Data related to trancRNAs (e.g., their expression and their location on naturally occurring arrays) is presented in the examples section below.

In some embodiments, a CRISPR/Cas trancRNA (e.g., a Cas12c trancRNA) has a length of from 25 nucleotides (nt) to 200 nt (e.g., 25-150, 25-100, 25-80, 25-70, 25-65, 25-60, 25-55, 35-200, 35-150, 35-100, 35-80, 35-70, 35-65, 35-60, 35-55, 40-200, 40-150, 40-100, 40-80, 40-70, 40-65, 40-60, 40-55, 45-200, 45-150, 45-100, 45-80, 45-70, 45-65, 45-60, or 45-55 nt). In some embodiments, a CRISPR/Cas trancRNA has a length of from 45-150 nt (e.g., 45-130, 45-120, 45-110, 45-90, 45-80, 60-150, 60-130, 60-120, 60-110, 60-90, or 60-80 nt). In some embodiments, a CRISPR/Cas trancRNA has a length of from 55-95 nt (e.g., 55-90, 55-85, 55-80, 60-95, 60-90, 60-85, 60-80, 65-95, 65-90, 65-85, or 65-80 nt). In some embodiments, a CRISPR/Cas trancRNA has a length of from 65-85 nt (e.g., 70-80 nt). In some embodiments, a CRISPR/Cas trancRNA has a length of about 75 nt. In some embodiments, a CRISPR/Cas trancRNA has a length of from 80-130 nt (e.g., 80-120, 80-115, 80-110, 90-130, 90-120, 90-115, 90-110, 100-130, 100-120, 100-115, or 100-110 nt). In some embodiments, a CRISPR/Cas trancRNA has a length of from 95-115 nt (e.g., 100-110 nt). In some embodiments, a CRISPR/Cas trancRNA has a length of about 105 nt.

In some embodiments, a CRISPR/Cas trancRNA (e.g., a CasY trancRNA) has a length of from 25 nucleotides (nt) to 200 nt (e.g., 25-150, 25-100, 25-80, 25-70, 25-65, 25-60, 25-55, 35-200, 35-150, 35-100, 35-80, 35-70, 35-65, 35-60, 35-55, 40-200, 40-150, 40-100, 40-80, 40-70, 40-65, 40-60, 40-55, 45-200, 45-150, 45-100, 45-80, 45-70, 45-65, 45-60, or 45-55 nt). In some embodiments, a CRISPR/Cas trancRNA has a length of from 35-80 nt (e.g., 35-70, 35-65, 35-60, 35-55, 40-80, 40-70, 40-65, 40-60, 40-55, 45-80, 45-70, 45-65, 45-60, or 45-55 nt). In some embodiments, a CRISPR/Cas trancRNA has a length of from 40-65 nt (e.g., 40-60, 40-55, 45-65, 45-60, or 45-55 nt). In some embodiments, a CRISPR/Cas trancRNA has a length of about 50 nt. In some embodiments, a CRISPR/Cas trancRNA has a length of from 45-55 nt.

In some embodiments, a CRISPR/Cas trancRNA (e.g., a CasZ trancRNA) has a length of from 60 nucleotides (nt) to 270 nt (e.g., 60-260, 70-270, 70-260, or 75-255 nt). In some embodiments, a CRISPR/Cas trancRNA (e.g., a CasZa trancRNA) has a length of from 60-150 nt (e.g., 60-140, 60-130, 65-150, 65-140, 65-130, 70-150, 70-140, or 70-130 nt). In some embodiments, a CRISPR/Cas trancRNA (e.g., a CasZa trancRNA) has a length of from 70-130 nt. In some embodiments, a CRISPR/Cas trancRNA (e.g., a CasZa trancRNA) has a length of about 80 nt. In some embodiments, a CRISPR/Cas trancRNA (e.g., a CasZa trancRNA) has a length of about 90 nt. In some embodiments, a CRISPR/Cas trancRNA (e.g., a CasZa trancRNA) has a length of about 120 nt.

In some embodiments, a CRISPR/Cas trancRNA (e.g., a CasZb trancRNA) has a length of from 85-240 nt (e.g., 85-230, 85-220, 85-150, 85-130, 95-240, 95-230, 95-220, 95-150, or 95-130 nt). In some embodiments, a CRISPR/Cas trancRNA (e.g., a CasZb trancRNA) has a length of from 95-120 nt. In some embodiments, a CRISPR/Cas trancRNA (e.g., a CasZb trancRNA) has a length of about 105 nt. In some embodiments, a CRISPR/Cas trancRNA (e.g., a CasZb trancRNA) has a length of about 115 nt. In some embodiments, a CRISPR/Cas trancRNA (e.g., a CasZb trancRNA) has a length of about 215 nt.

In some embodiments, a CRISPR/Cas trancRNA (e.g., a CasZc trancRNA) has a length of from 80-275 nt (e.g., 85-260 nt). In some embodiments, a CRISPR/Cas trancRNA (e.g., a CasZc trancRNA) has a length of from 80-110 nt (e.g., 85-105 nt). In some embodiments, a CRISPR/Cas trancRNA (e.g., a CasZc trancRNA) has a length of from 235-270 nt (e.g., 240-260 nt). In some embodiments, a CRISPR/Cas trancRNA (e.g., a CasZc trancRNA) has a length of about 95 nt. In some embodiments, a CRISPR/Cas trancRNA (e.g., a CasZc trancRNA) has a length of about 250 nt.

Examples of trancRNA sequences are presented in Table 2.

TABLE 2

CRISPR/Cas trancRNA sequences

| Cas Protein | trancRNA sequence | SEQ ID NO |
|---|---|---|
| Cas12c_1 (long) | AUACCACCCGUGCAUUUCUGGAUCAAUGAUCCGUACCUC AAUGUCCGGGCGCGCAGCUAGAGCGACCUGAAAUCUGCA CGAAAACCGGCGAAAGCCGGUUUUUUGU | 243 |
| Cas12c_1 (short) | AUACCACCCGUGCAUUUCUGGAUCAAUGAUCCGUACCUC AAUGUCCGGGCGCGCAGCUAGAGCGACCUGAAAUCU | 244 |
| CasY1 | CUCCGAAAGUAUCAAAAUAAAAAGGGUUUCCAGUUUUUA ACUAAACUUUAGCCUUCCACCCUUUCCUGAUUUUGUU | 245 |
| CasY2 | ACCUGCCAAAAUUUCGUUCAACGAAACUUAAGCAGGCAA GAAAAUUUAAAAUUAAAUCCGCUGGUGGGCGGAUAAAG UC | 246 |

TABLE 2-continued

CRISPR/Cas trancRNA sequences

| Cas Protein | trancRNA sequence | SEQ ID NO |
|---|---|---|
| CasY4 | GGUAUUUCCGGACAGCGGCUUGACCGCAUCGUCCUCGCC UUUUCCUAAAAU | 247 |
| Za.1 | CGATTCCTCCCTACAGTAGTTAGGTATAGCCGAAAGGTAG AGACTAAATCTGTAGTTGGAGTGGGCCGCTTGCATCGGCC | 248 |
| Za.2 | TCGTCTCGAGGGTTACCAAAATTGGCACTTCTCGACTTTAG GCCGATGCAAGCGGCCCACTCCACTACAGATTTAGTCTCTA CCTTGCGGCTATACCTAACTTACTGTAGGGAGGAATCGTG | 249 |
| Za.3 | CTTCACTGATAAAGTGGAGAACCGCTTCACCAAAAGCTGT CCCTTAGGGGATTAGAACTTGAGTGAAGGTGGGCTGCTTG CATCAGCCTAA | 250 |
| Zb.2 | CAGAATAATACTGACTTACTAAGATATCTTGAGGGTATACC CGAAAAGATTGGCGTTGTTGCAACGCAATAAGATGTAAAT CTGAAAAGGTTTGGAATCATATAAATAATTTTA | 251 |
| Zb.4 | AAGCCAAGATATGGAATGCCATTGTAATATTATGGTGTTG ACTTAGTTTAGATTTAAACAATCTTCGATGGCTATATGCGG AAGGTTTGGCGTCGTTGTAACGC | 252 |
| Zb.6 | CAGTGTGCATAGCTATAACACTACGCAAAGACTGCTAAAG AGCGATGTGCTCTATCGCAGTCTCACCTTTAATGGACTTAC GGATCTTTTGGAGCACTAAGCTCCGCTGCGGTGCAACACC GCCCTTTTCTTGCCTCTGCTTGCCCTTTCCGGTTATTATAGC CGGGAGAGTGCGGAAGATTACCGCTCTAGCTCGCAGCATG TTACTGAGTC | 253 |
| Zc.3 | GCAAGTCATTCGGGGACACTTTTTGTTATTTAAAGTGTTTT AGATAAATCAGTGTCATGCTGAATAACGACCCGACCTATA AATAACATAATCC | 254 |
| Zc.5 | GTCCTTAAGGTACTACACATTACATGTGAACGTGGAGCTA ATAATAGAAATATTATTAGACTACACCTTATTAATAACGGT AGGAGATCTATATGGTCTTGAATGGAATAGTAATTGTGAA ATTATAATTTCTGTTCTTAGCTACTTAAGATGGCTCGTTGC AAGCCACTCGGGGGCTCTCTTGAAGTCAAAGAGCTTTAGA CAAATCAGTGTCAAACTGAATAACGACCCGACCATGACTT CATAATCCCG | 255 |

In some cases, a subject CRISPR/Cas trancRNA comprises a Cas12c trancRNA sequence. In some cases, a subject CRISPR/Cas trancRNA comprises a Cas12c trancRNA sequence of Table 2. In some cases, a subject CRISPR/Cas trancRNA comprises the Cas12c_1 (long) trancRNA sequence of Table 2. In some cases, a subject CRISPR/Cas trancRNA comprises a nucleotide sequence having 70% or more identity (e.g., 75% or more, 80% or more, 85% or more, 90% or more, 93% or more, 95% or more, 97% or more, 98% or more, or 100% identity) with the Cas12c_1 (long) trancRNA sequence of Table 2. In some cases, a subject CRISPR/Cas trancRNA comprises a nucleotide sequence having 80% or more identity (e.g., 85% or more, 90% or more, 93% or more, 95% or more, 97% or more, 98% or more, or 100% identity) with the Cas12c_1 (long) trancRNA sequence of Table 2. In some cases, a subject CRISPR/Cas trancRNA comprises a nucleotide sequence having 90% or more identity (e.g., 93% or more, 95% or more, 97% or more, 98% or more, or 100% identity) with the Cas12c_1 (long) trancRNA sequence of Table 2. In some cases, a subject CRISPR/Cas trancRNA comprises a nucleotide sequence having 80% or more identity (e.g., 85% or more, 90% or more, 93% or more, 95% or more, 97% or more, 98% or more, or 100% identity) with the Cas12c_1 (long) trancRNA sequence of Table 2, and has a length of from 80-130 nt (e.g., 80-120, 80-115, 80-110, 90-130, 90-120, 90-115, 90-110, 100-130, 100-120, 100-115, or 100-110 nt).

In some cases, a subject CRISPR/Cas trancRNA comprises a Cas12c trancRNA sequence. In some cases, a subject CRISPR/Cas trancRNA comprises the Cas12c_1 (short) trancRNA sequence of Table 2. In some cases, a subject CRISPR/Cas trancRNA comprises a nucleotide sequence having 70% or more identity (e.g., 75% or more, 80% or more, 85% or more, 90% or more, 93% or more, 95% or more, 97% or more, 98% or more, or 100% identity) with the Cas12c_1 (short) trancRNA sequence of Table 2. In some cases, a subject CRISPR/Cas trancRNA comprises a nucleotide sequence having 80% or more identity (e.g., 85% or more, 90% or more, 93% or more, 95% or more, 97% or more, 98% or more, or 100% identity) with the Cas12c_1 (short) trancRNA sequence of Table 2. In some cases, a subject CRISPR/Cas trancRNA comprises a nucleotide sequence having 90% or more identity (e.g., 93% or more, 95% or more, 97% or more, 98% or more, or 100% identity) with the Cas12c_1 (short) trancRNA sequence of Table 2. In some cases, a subject CRISPR/Cas trancRNA comprises a nucleotide sequence having 80% or more identity (e.g., 85% or more, 90% or more, 93% or more, 95% or more, 97% or more, 98% or more, or 100% identity) with the Cas12c_1 (short) trancRNA sequence of Table 2, and has a length of from 55-95 nt (e.g., 55-90, 55-85, 55-80, 60-95, 60-90, 60-85, 60-80, 65-95, 65-90, 65-85, or 65-80 nt).

In some cases, a subject CRISPR/Cas trancRNA comprises the Cas12c_1 (long) or Cas12c_1 (short) trancRNA sequence of Table 2. In some cases, a subject CRISPR/Cas trancRNA comprises a nucleotide sequence having 70% or more identity (e.g., 75% or more, 80% or more, 85% or more, 90% or more, 93% or more, 95% or more, 97% or more, 98% or more, or 100% identity) with the Cas12c_1 (long) or Cas12c_1 (short) trancRNA sequence of Table 2. In some cases, a subject CRISPR/Cas trancRNA comprises a nucleotide sequence having 80% or more identity (e.g., 85% or more, 90% or more, 93% or more, 95% or more, 97% or more, 98% or more, or 100% identity) with the Cas12c_1 (long) or Cas12c_1 (short) trancRNA sequence of Table 2. In some cases, a subject CRISPR/Cas trancRNA comprises a nucleotide sequence having 90% or more identity (e.g., 93% or more, 95% or more, 97% or more, 98% or more, or 100% identity) with the Cas12c_1 (long) or Cas12c_1 (short) trancRNA sequence of Table 2. In some cases, a subject CRISPR/Cas trancRNA comprises a nucleotide sequence having 80% or more identity (e.g., 85% or more, 90% or more, 93% or more, 95% or more, 97% or more, 98% or more, or 100% identity) with the Cas12c_1 (long) or Cas12c_1 (short) trancRNA sequence of Table 2, and has a length of from 45-150 nt (e.g., 45-130, 45-120, 45-110, 45-90, 45-80, 60-150, 60-130, 60-120, 60-110, 60-90, or 60-80 nt).

In some cases, a subject CRISPR/Cas trancRNA comprises a CasY trancRNA sequence. In some cases, a subject CRISPR/Cas trancRNA comprises a CasY1 trancRNA sequence. In some cases, a subject CRISPR/Cas trancRNA comprises the CasY1 trancRNA sequence of Table 2. In some cases, a subject CRISPR/Cas trancRNA comprises a nucleotide sequence having 70% or more identity (e.g., 75% or more, 80% or more, 85% or more, 90% or more, 93% or more, 95% or more, 97% or more, 98% or more, or 100% identity) with the CasY1 trancRNA sequence of Table 2. In some cases, a subject CRISPR/Cas trancRNA comprises a nucleotide sequence having 80% or more identity (e.g., 85% or more, 90% or more, 93% or more, 95% or more, 97% or more, 98% or more, or 100% identity) with the CasY1 trancRNA sequence of Table 2. In some cases, a subject CRISPR/Cas trancRNA comprises a nucleotide sequence having 90% or more identity (e.g., 93% or more, 95% or more, 97% or more, 98% or more, or 100% identity) with the CasY1 trancRNA sequence of Table 2. In some cases, a subject CRISPR/Cas trancRNA comprises a nucleotide sequence having 80% or more identity (e.g., 85% or more, 90% or more, 93% or more, 95% or more, 97% or more, 98% or more, or 100% identity) with the CasY1 trancRNA sequence of Table 2, and has a length of from 35-80 nt (e.g., 35-70, 35-65, 35-60, 35-55, 40-80, 40-70, 40-65, 40-60, 40-55, 45-80, 45-70, 45-65, 45-60, or 45-55 nt).

In some cases, a subject CRISPR/Cas trancRNA comprises the CasY2 trancRNA sequence. In some cases, a subject CRISPR/Cas trancRNA comprises the CasY2 trancRNA sequence of Table 2. In some cases, a subject CRISPR/Cas trancRNA comprises a nucleotide sequence having 70% or more identity (e.g., 75% or more, 80% or more, 85% or more, 90% or more, 93% or more, 95% or more, 97% or more, 98% or more, or 100% identity) with the CasY2 trancRNA sequence of Table 2. In some cases, a subject CRISPR/Cas trancRNA comprises a nucleotide sequence having 80% or more identity (e.g., 85% or more, 90% or more, 93% or more, 95% or more, 97% or more, 98% or more, or 100% identity) with the CasY2 trancRNA sequence of Table 2. In some cases, a subject CRISPR/Cas trancRNA comprises a nucleotide sequence having 90% or more identity (e.g., 93% or more, 95% or more, 97% or more, 98% or more, or 100% identity) with the CasY2 trancRNA sequence of Table 2. In some cases, a subject CRISPR/Cas trancRNA comprises a nucleotide sequence having 80% or more identity (e.g., 85% or more, 90% or more, 93% or more, 95% or more, 97% or more, 98% or more, or 100% identity) with the CasY2 trancRNA sequence of Table 2, and has a length of from 35-80 nt (e.g., 35-70, 35-65, 35-60, 35-55, 40-80, 40-70, 40-65, 40-60, 40-55, 45-80, 45-70, 45-65, 45-60, or 45-55 nt).

In some cases, a subject CRISPR/Cas trancRNA comprises the CasY4 trancRNA sequence. In some cases, a subject CRISPR/Cas trancRNA comprises the CasY4 trancRNA sequence of Table 2. In some cases, a subject CRISPR/Cas trancRNA comprises a nucleotide sequence having 70% or more identity (e.g., 75% or more, 80% or more, 85% or more, 90% or more, 93% or more, 95% or more, 97% or more, 98% or more, or 100% identity) with the CasY4 trancRNA sequence of Table 2. In some cases, a subject CRISPR/Cas trancRNA comprises a nucleotide sequence having 80% or more identity (e.g., 85% or more, 90% or more, 93% or more, 95% or more, 97% or more, 98% or more, or 100% identity) with the CasY4 trancRNA sequence of Table 2. In some cases, a subject CRISPR/Cas trancRNA comprises a nucleotide sequence having 90% or more identity (e.g., 93% or more, 95% or more, 97% or more, 98% or more, or 100% identity) with the CasY4 trancRNA sequence of Table 2. In some cases, a subject CRISPR/Cas trancRNA comprises a nucleotide sequence having 80% or more identity (e.g., 85% or more, 90% or more, 93% or more, 95% or more, 97% or more, 98% or more, or 100% identity) with the CasY4 trancRNA sequence of Table 2, and has a length of from 35-80 nt (e.g., 35-70, 35-65, 35-60, 35-55, 40-80, 40-70, 40-65, 40-60, 40-55, 45-80, 45-70, 45-65, 45-60, or 45-55 nt).

In some cases, a subject CRISPR/Cas trancRNA comprises the CasY1, CasY2, or CasY4 trancRNA sequence of Table 2. In some cases, a subject CRISPR/Cas trancRNA comprises a nucleotide sequence having 70% or more identity (e.g., 75% or more, 80% or more, 85% or more, 90% or more, 93% or more, 95% or more, 97% or more, 98% or more, or 100% identity) with the CasY1, CasY2, or CasY4 trancRNA sequence of Table 2. In some cases, a subject CRISPR/Cas trancRNA comprises a nucleotide sequence having 80% or more identity (e.g., 85% or more, 90% or more, 93% or more, 95% or more, 97% or more, 98% or more, or 100% identity) with the CasY1, CasY2, or CasY4 trancRNA sequence of Table 2. In some cases, a subject CRISPR/Cas trancRNA comprises a nucleotide sequence having 90% or more identity (e.g., 93% or more, 95% or more, 97% or more, 98% or more, or 100% identity) with the CasY1, CasY2, or CasY4 trancRNA sequence of Table 2. In some cases, a subject CRISPR/Cas trancRNA comprises a nucleotide sequence having 80% or more identity (e.g., 85% or more, 90% or more, 93% or more, 95% or more, 97% or more, 98% or more, or 100% identity) with the CasY1, CasY2, or CasY4 trancRNA sequence of Table 2, and has a length of from 35-80 nt (e.g., 35-70, 35-65, 35-60, 35-55, 40-80, 40-70, 40-65, 40-60, 40-55, 45-80, 45-70, 45-65, 45-60, or 45-55 nt).

In some cases, a subject CRISPR/Cas trancRNA comprises a CasZ trancRNA sequence. In some cases, a subject CRISPR/Cas trancRNA comprises a CasZa trancRNA sequence. In some cases, a subject CRISPR/Cas trancRNA comprises a CasZa trancRNA sequence of Table 2. In some cases, a subject CRISPR/Cas trancRNA comprises a nucleotide sequence having 70% or more identity (e.g., 75% or more, 80% or more, 85% or more, 90% or more, 93% or more, 95% or more, 97% or more, 98% or more, or 100% identity) with a CasZa trancRNA sequence of Table 2. In some cases, a subject CRISPR/Cas trancRNA comprises a nucleotide sequence having 80% or more identity (e.g., 85% or more, 90% or more, 93% or more, 95% or more, 97% or more, 98% or more, or 100% identity) with a CasZa trancRNA sequence of Table 2. In some cases, a subject CRISPR/Cas trancRNA comprises a nucleotide sequence having 90% or more identity (e.g., 93% or more, 95% or more, 97% or more, 98% or more, or 100% identity) with a CasZa trancRNA sequence of Table 2. In some cases, a subject CRISPR/Cas trancRNA comprises a nucleotide sequence having 80% or more identity (e.g., 85% or more, 90% or more, 93% or more, 95% or more, 97% or more, 98% or more, or 100% identity) with a CasZa trancRNA sequence of Table 2, and has a length of from 60-150 nt (e.g., 60-140, 60-130, 65-150, 65-140, 65-130, 70-150, 70-140, or 70-130 nt).

In some cases, a subject CRISPR/Cas trancRNA comprises a CasZb trancRNA sequence. In some cases, a subject CRISPR/Cas trancRNA comprises a CasZb trancRNA sequence of Table 2. In some cases, a subject CRISPR/Cas trancRNA comprises a nucleotide sequence having 70% or more identity (e.g., 75% or more, 80% or more, 85% or more, 90% or more, 93% or more, 95% or more, 97% or more, 98% or more, or 100% identity) with a CasZb trancRNA sequence of Table 2. In some cases, a subject CRISPR/Cas trancRNA comprises a nucleotide sequence having 80% or more identity (e.g., 85% or more, 90% or more, 93% or more, 95% or more, 97% or more, 98% or more, or 100% identity) with a CasZb trancRNA sequence of Table 2. In some cases, a subject CRISPR/Cas trancRNA comprises a nucleotide sequence having 90% or more identity (e.g., 93% or more, 95% or more, 97% or more, 98% or more, or 100% identity) with a CasZb trancRNA sequence of Table 2. In some cases, a subject CRISPR/Cas trancRNA comprises a nucleotide sequence having 80% or more identity (e.g., 85% or more, 90% or more, 93% or more, 95% or more, 97% or more, 98% or more, or 100% identity) with a CasZb trancRNA sequence of Table 2, and has a length of from 85-240 nt (e.g., 85-230, 85-220, 85-150, 85-130, 95-240, 95-230, 95-220, 95-150, or 95-130 nt).

In some cases, a subject CRISPR/Cas trancRNA comprises a CasZc trancRNA sequence. In some cases, a subject CRISPR/Cas trancRNA comprises a CasZc trancRNA sequence of Table 2. In some cases, a subject CRISPR/Cas trancRNA comprises a nucleotide sequence having 70% or more identity (e.g., 75% or more, 80% or more, 85% or more, 90% or more, 93% or more, 95% or more, 97% or more, 98% or more, or 100% identity) with a CasZc trancRNA sequence of Table 2. In some cases, a subject CRISPR/Cas trancRNA comprises a nucleotide sequence having 80% or more identity (e.g., 85% or more, 90% or more, 93% or more, 95% or more, 97% or more, 98% or more, or 100% identity) with a CasZc trancRNA sequence of Table 2. In some cases, a subject CRISPR/Cas trancRNA comprises a nucleotide sequence having 90% or more identity (e.g., 93% or more, 95% or more, 97% or more, 98% or more, or 100% identity) with a CasZc trancRNA sequence of Table 2. In some cases, a subject CRISPR/Cas trancRNA comprises a nucleotide sequence having 80% or more identity (e.g., 85% or more, 90% or more, 93% or more, 95% or more, 97% or more, 98% or more, or 100% identity) with a CasZc trancRNA sequence of Table 2, and has a length of from 80-110 nt (e.g., 85-105 nt) or from 235-270 nt (e.g., 240-260 nt).

In some cases, a subject CRISPR/Cas trancRNA comprises a CasZa, CasZb, or CasZc trancRNA sequence of Table 2. In some cases, a subject CRISPR/Cas trancRNA comprises a nucleotide sequence having 70% or more identity (e.g., 75% or more, 80% or more, 85% or more, 90% or more, 93% or more, 95% or more, 97% or more, 98% or more, or 100% identity) with a CasZa, CasZb, or CasZc trancRNA sequence of Table 2. In some cases, a subject CRISPR/Cas trancRNA comprises a nucleotide sequence having 80% or more identity (e.g., 85% or more, 90% or more, 93% or more, 95% or more, 97% or more, 98% or more, or 100% identity) with a CasZa, CasZb, or CasZc trancRNA sequence of Table 2. In some cases, a subject CRISPR/Cas trancRNA comprises a nucleotide sequence having 90% or more identity (e.g., 93% or more, 95% or more, 97% or more, 98% or more, or 100% identity) with a CasZa, CasZb, or CasZc trancRNA sequence of Table 2. In some cases, a subject CRTSPR/Cas trancRNA comprises a nucleotide sequence having 80% or more identity (e.g., 85% or more, 90% or more, 93% or more, 95% or more, 97% or more, 98% or more, or 100% identity) with a CasZa, CasZb, or CasZc trancRNA sequence of Table 2, and has a length of from 60 nucleotides (nt) to 270 nt (e.g., 60-260, 70-270, 70-260, or 75-255 nt).

In some cases, a CRISPR/Cas trancRNA comprises a modified nucleotide (e.g., methylated). In some cases, a CRISPR/Cas trancRNA comprises one or more of: i) a base modification or substitution; ii) a backbone modification; iii) a modified internucleoside linkage; and iv) a modified sugar moiety. Possible nucleic acid modifications are described below.

Class 2 CRISPR/Cas Systems

The present disclosure provides a Class 2 CRISPR/Cas system. A Class 2 CRISPR/Cas system of the present disclosure can comprise one or more of: (1) a CRISPR/Cas transactivating noncoding RNA (trancRNA) (referred to herein as a "CRISPR/Cas trancRNA") or a nucleic acid encoding the CRISPR/Cas trancRNA (e.g., an expression vector); (2) a Class 2 CRISPR/Cas effector protein (e.g., a wild type protein, a variant, a catalytically compromised variant, a fusion protein, and the like) or a nucleic acid encoding the Class 2 CRISPR/Cas effector protein (e.g., an RNA, an expression vector, and the like); and (3) a CRISPR/Cas guide RNA (that binds to and provides sequence specificity to the Class 2 CRISPR/Cas effector protein, e.g., a guide RNA that can bind to a target sequence of a eukaryotic genome) or a nucleic acid encoding the CRISPR/Cas guide RNA)(e.g., an expression vector). A Class 2 CRISPR/Cas system can include a host cell (e.g., a eukaryotic cell, a plant cell, a mammalian cell, a human cell) that comprises one or more of (1), (2), and (3) (in any combination), e.g., in some cases the host cell comprises a trancRNA and/or a nucleic acid encoding the trancRNA. In some cases a Class 2 CRISPR/Cas system includes (e.g., in addition to the above) a donor template nucleic acid. In some cases the Class 2 CRISPR/Cas system is a system of one or more nucleic acids (e.g., one or more expression vectors encoding any combination of the above).

Nucleic Acids

The present disclosure provides one or more nucleic acids comprising one or more of: a CRISPR/Cas trancRNA sequence, a nucleotide sequence encoding a CRISPR/Cas trancRNA, a nucleotide sequence encoding a Class 2 CRISPR/Cas effector protein (e.g., a wild type Class 2 CRISPR/Cas effector protein, a nickase, a dEffector, a chimeric protein/fusion protein, and the like), a CRISPR/Cas guide RNA sequence, a nucleotide sequence encoding a CRISPR/Cas guide RNA, and a donor polynucleotide (donor template, donor DNA) sequence. In some cases, a subject nucleic acid (e.g., the one or more nucleic acids) is a recombinant expression vector (e.g., plasmid, viral vector, minicircle DNA, and the like). In some cases, the nucleotide sequence encoding the CRISPR/Cas trancRNA, the nucleotide sequence encoding the Class 2 CRISPR/Cas effector protein, and/or the nucleotide sequence encoding the CRISPR/Cas guide RNA is (are) operably linked to a promoter (e.g., an inducible promoter), e.g., one that is operable in a cell type of choice (e.g., a prokaryotic cell, a eukaryotic cell, a plant cell, an animal cell, a mammalian cell, a primate cell, a rodent cell, a human cell, etc.).

In some cases, a nucleotide sequence encoding a Class 2 CRISPR/Cas effector protein of the present disclosure is codon optimized. This type of optimization can entail a mutation of a Class 2 CRISPR/Cas effector protein-encoding nucleotide sequence to mimic the codon preferences of the intended host organism or cell while encoding the same protein. Thus, the codons can be changed, but the encoded protein remains unchanged. For example, if the intended target cell was a human cell, a human codon-optimized Class 2 CRISPR/Cas effector protein-encoding nucleotide sequence could be used. As another non-limiting example, if the intended host cell were a mouse cell, then a mouse codon-optimized Class 2 CRISPR/Cas effector protein-encoding nucleotide sequence could be generated. As another non-limiting example, if the intended host cell were a plant cell, then a plant codon-optimized Class 2 CRISPR/Cas effector protein-encoding nucleotide sequence could be generated. As another non-limiting example, if the intended host cell were an insect cell, then an insect codon-optimized Class 2 CRISPR/Cas effector protein-encoding nucleotide sequence could be generated.

The present disclosure provides one or more recombinant expression vectors that include (in different recombinant expression vectors in some cases, and in the same recombinant expression vector in some cases): a CRISPR/Cas trancRNA sequence, a nucleotide sequence encoding a CRISPR/Cas trancRNA, a nucleotide sequence encoding a Class 2 CRISPR/Cas effector protein (e.g., a wild type Class 2 CRISPR/Cas effector protein, a nickase, a dEffector, a chimeric protein/fusion protein, and the like), a CRISPR/Cas guide RNA sequence, a nucleotide sequence encoding a CRISPR/Cas guide RNA, and a donor polynucleotide (donor template, donor DNA) sequence. In some cases, a subject nucleic acid (e.g., the one or more nucleic acids) is a recombinant expression vector (e.g., plasmid, viral vector, minicircle DNA, and the like). In some cases, the nucleotide sequence encoding the CRISPR/Cas trancRNA, the nucleotide sequence encoding the Class 2 CRISPR/Cas effector protein, and/or the nucleotide sequence encoding the CRISPR/Cas guide RNA is (are) operably linked to a promoter (e.g., an inducible promoter), e.g., one that is operable in a cell type of choice (e.g., a prokaryotic cell, a eukaryotic cell, a plant cell, an animal cell, a mammalian cell, a primate cell, a rodent cell, a human cell, etc.).

Suitable expression vectors include viral expression vectors (e.g. viral vectors based on vaccinia virus; poliovirus; adenovirus (see, e.g., Li et al., Invest Opthalmol Vis Sci 35:2543 2549, 1994; Borras et al., Gene Ther 6:515 524, 1999; Li and Davidson, PNAS 92:7700 7704, 1995; Sakamoto et al., H Gene Ther 5:1088 1097, 1999; WO 94/12649, WO 93/03769; WO 93/19191; WO 94/28938; WO 95/11984 and WO 95/00655); adeno-associated virus (AAV) (see, e.g., Ali et al., Hum Gene Ther 9:81 86, 1998, Flannery et al., PNAS 94:6916 6921, 1997; Bennett et al., Invest Opthalmol Vis Sci 38:2857 2863, 1997; Jomary et al., Gene Ther 4:683 690, 1997, Rolling et al., Hum Gene Ther 10:641 648, 1999; Ali et al., Hum Mol Genet 5:591 594, 1996; Srivastava in WO 93/09239, Samulski et al., J. Vir. (1989) 63:3822-3828; Mendelson et al., Virol. (1988) 166:154-165; and Flotte et al., PNAS (1993) 90:10613-10617); SV40; herpes simplex virus; human immunodeficiency virus (see, e.g., Miyoshi et al., PNAS 94:10319 23, 1997; Takahashi et al., J Virol 73:7812 7816, 1999); a retroviral vector (e.g., Murine Leukemia Virus, spleen necrosis virus, and vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus); and the like. In some cases, a recombinant expression vector of the present disclosure is a recombinant adeno-associated virus (AAV) vector. In some cases, a recombinant expression vector of the present disclosure is a recombinant lentivirus vector. In some cases, a recombinant expression vector of the present disclosure is a recombinant retroviral vector.

Depending on the host/vector system utilized, any of a number of suitable transcription and translation control elements, including constitutive and inducible promoters, transcription enhancer elements, transcription terminators, etc. may be used in the expression vector.

In some embodiments, a nucleotide sequence encoding a CRISPR/Cas guide RNA is operably linked to a control element, e.g., a transcriptional control element, such as a promoter. In some embodiments, a nucleotide sequence encoding a Class 2 CRISPR/Cas effector protein or a Class 2 CRISPR/Cas effector fusion polypeptide is operably linked to a control element, e.g., a transcriptional control element, such as a promoter.

The transcriptional control element can be a promoter. In some cases, the promoter is a constitutively active promoter. In some cases, the promoter is a regulatable promoter. In some cases, the promoter is an inducible promoter. In some cases, the promoter is a tissue-specific promoter. In some cases, the promoter is a cell type-specific promoter. In some cases, the transcriptional control element (e.g., the promoter) is functional in a targeted cell type or targeted cell population. For example, in some cases, the transcriptional control element can be functional in eukaryotic cells, e.g., hematopoietic stem cells (e.g., mobilized peripheral blood (mPB) CD34(+) cell, bone marrow (BM) CD34(+) cell, etc.).

Non-limiting examples of eukaryotic promoters (promoters functional in a eukaryotic cell) include EF1α, those from cytomegalovirus (CMV) immediate early, herpes simplex virus (HSV) thymidine kinase, early and late SV40, long terminal repeats (LTRs) from retrovirus, and mouse metallothionein-I. Selection of the appropriate vector and promoter is well within the level of ordinary skill in the art. The expression vector may also contain a ribosome binding site for translation initiation and a transcription terminator. The expression vector may also include appropriate sequences for amplifying expression. The expression vector may also include nucleotide sequences encoding protein tags (e.g., 6×His tag, hemagglutinin tag, fluorescent protein, etc.) that can be fused to the Class 2 CRTSPR/Cas effector protein, thus resulting in a chimeric Class 2 CRISPR/Cas effector protein.

In some embodiments, a nucleotide sequence encoding a CRISPR/Cas guide RNA and/or a Class 2 CRISPR/Cas effector fusion polypeptide is operably linked to an inducible promoter. In some embodiments, a nucleotide sequence encoding a CRISPR/Cas guide RNA and/or a Class 2 CRISPR/Cas effector fusion protein is operably linked to a constitutive promoter.

A promoter can be a constitutively active promoter (i.e., a promoter that is constitutively in an active/"ON" state), it may be an inducible promoter (i.e., a promoter whose state, active/"ON" or inactive/"OFF", is controlled by an external stimulus, e.g., the presence of a particular temperature, compound, or protein.), it may be a spatially restricted promoter (i.e., transcriptional control element, enhancer, etc.)(e.g., tissue specific promoter, cell type specific promoter, etc.), and it may be a temporally restricted promoter (i.e., the promoter is in the "ON" state or "OFF" state during specific stages of embryonic development or during specific stages of a biological process, e.g., hair follicle cycle in mice).

Suitable promoters can be derived from viruses and can therefore be referred to as viral promoters, or they can be derived from any organism, including prokaryotic or eukaryotic organisms. Suitable promoters can be used to drive expression by any RNA polymerase (e.g., pol I, pol II, pol III). Exemplary promoters include, but are not limited to the SV40 early promoter, mouse mammary tumor virus long terminal repeat (LTR) promoter; adenovirus major late promoter (Ad MLP); a herpes simplex virus (HSV) promoter, a cytomegalovirus (CMV) promoter such as the CMV immediate early promoter region (CMVIE), a rous sarcoma virus (RSV) promoter, a human U6 small nuclear promoter (U6) (Miyagishi et al., Nature Biotechnology 20, 497-500 (2002)), an enhanced U6 promoter (e.g., Xia et al., Nucleic Acids Res. 2003 Sep. 1; 31(17)), a human H1 promoter (H1), and the like.

In some cases, a nucleotide sequence encoding a CRISPR/Cas guide RNA is operably linked to (under the control of) a promoter operable in a eukaryotic cell (e.g., a U6 promoter, an enhanced U6 promoter, an H1 promoter, and the like). As would be understood by one of ordinary skill in the art, when expressing an RNA (e.g., a guide RNA) from a nucleic acid (e.g., an expression vector) using a U6 promoter (e.g., in a eukaryotic cell), or another PolIII promoter, the RNA may need to be mutated if there are several Ts in a row (coding for Us in the RNA). This is because a string of Ts (e.g., 5 Ts) in DNA can act as a terminator for polymerase 111 (P01111). Thus, in order to ensure transcription of a guide RNA in a eukaryotic cell it may sometimes be necessary to modify the sequence encoding the guide RNA to eliminate runs of Ts. In some cases, a nucleotide sequence encoding a Class 2 CRISPR/Cas effector protein (e.g., a wild type protein, a nickase, a dEffector, a chimeric protein and the like) is operably linked to a promoter operable in a eukaryotic cell (e.g., a CMV promoter, an EF1α promoter, an estrogen receptor-regulated promoter, and the like).

Examples of inducible promoters include, but are not limited to T7 RNA polymerase promoter, T3 RNA polymerase promoter, Isopropyl-beta-D-thiogalactopyranoside (IPTG)-regulated promoter, lactose induced promoter, heat shock promoter, Tetracycline-regulated promoter, Steroid-regulated promoter, Metal-regulated promoter, estrogen receptor-regulated promoter, etc. Inducible promoters can therefore be regulated by molecules including, but not limited to, doxycycline; estrogen and/or an estrogen analog; IPTG; etc.

Inducible promoters suitable for use include any inducible promoter described herein or known to one of ordinary skill in the art. Examples of inducible promoters include, without limitation, chemically/biochemically-regulated and physically-regulated promoters such as alcohol-regulated promoters, tetracycline-regulated promoters (e.g., anhydrotetracycline (aTc)-responsive promoters and other tetracycline-responsive promoter systems, which include a tetracycline repressor protein (tetR), a tetracycline operator sequence (tetO) and a tetracycline transactivator fusion protein (tTA)), steroid-regulated promoters (e.g., promoters based on the rat glucocorticoid receptor, human estrogen receptor, moth ecdysone receptors, and promoters from the steroid/retinoid/thyroid receptor superfamily), metal-regulated promoters (e.g., promoters derived from metallothionein (proteins that bind and sequester metal ions) genes from yeast, mouse and human), pathogenesis-regulated promoters (e.g., induced by salicylic acid, ethylene or benzothiadiazole (BTH)), temperature/heat-inducible promoters (e.g., heat shock promoters), and light-regulated promoters (e.g., light responsive promoters from plant cells).

In some cases, the promoter is a spatially restricted promoter (i.e., cell type specific promoter, tissue specific promoter, etc.) such that in a multi-cellular organism, the promoter is active (i.e., "ON") in a subset of specific cells. Spatially restricted promoters may also be referred to as enhancers, transcriptional control elements, control sequences, etc. Any convenient spatially restricted promoter may be used as long as the promoter is functional in the targeted host cell (e.g., eukaryotic cell; prokaryotic cell).

In some cases, the promoter is a reversible promoter. Suitable reversible promoters, including reversible inducible promoters are known in the art. Such reversible promoters may be isolated and derived from many organisms, e.g., eukaryotes and prokaryotes. Modification of reversible promoters derived from a first organism for use in a second organism, e.g., a first prokaryote and a second a eukaryote, a first eukaryote and a second a prokaryote, etc., is well known in the art. Such reversible promoters, and systems based on such reversible promoters but also comprising additional control proteins, include, but are not limited to, alcohol regulated promoters (e.g., alcohol dehydrogenase I (alcA) gene promoter, promoters responsive to alcohol transactivator proteins (AlcR), etc.), tetracycline regulated promoters, (e.g., promoter systems including TetActivators, TetON, TetOFF, etc.), steroid regulated promoters (e.g., rat glucocorticoid receptor promoter systems, human estrogen receptor promoter systems, retinoid promoter systems, thyroid promoter systems, ecdysone promoter systems, mifepristone promoter systems, etc.), metal regulated promoters (e.g., metallothionein promoter systems, etc.), pathogenesis-related regulated promoters (e.g., salicylic acid regulated promoters, ethylene regulated promoters, benzothiadiazole regulated promoters, etc.), temperature regulated promoters (e.g., heat shock inducible promoters (e.g., HSP-70, HSP-90, soybean heat shock promoter, etc.), light regulated promoters, synthetic inducible promoters, and the like.

Methods of introducing a nucleic acid (e.g., a nucleic acid comprising a donor polynucleotide sequence, one or more nucleic acids encoding a Class 2 CRISPR/Cas effector protein and/or a CRISPR/Cas guide RNA, and the like) into a host cell are known in the art, and any convenient method can be used to introduce a nucleic acid (e.g., an expression construct) into a cell. Suitable methods include e.g., viral infection, transfection, lipofection, electroporation, calcium phosphate precipitation, polyethyleneimine (PEI)-mediated transfection, DEAE-dextran mediated transfection, liposome-mediated transfection, particle gun technology, calcium phosphate precipitation, direct microinjection, nanoparticle-mediated nucleic acid delivery, and the like.

Introducing the recombinant expression vector into cells can occur in any culture media and under any culture conditions that promote the survival of the cells. Introducing the recombinant expression vector into a target cell can be carried out in vivo or ex vivo. Introducing the recombinant expression vector into a target cell can be carried out in vitro.

In some embodiments, a Class 2 CRISPR/Cas effector protein can be provided as RNA. The RNA can be provided by direct chemical synthesis or may be transcribed in vitro from a DNA (e.g., encoding the Class 2 CRISPR/Cas effector protein). Once synthesized, the RNA may be introduced into a cell by any of the well-known techniques for introducing nucleic acids into cells (e.g., microinjection, electroporation, transfection, etc.).

Nucleic acids may be provided to the cells using well-developed transfection techniques; see, e.g. Angel and Yanik (2010) PLoS ONE 5(7): e11756, and the commercially available TransMessenger® reagents from Qiagen, Stemfect™ RNA Transfection Kit from Stemgent, and TransIT®-mRNA Transfection Kit from Minis Bio LLC. See also Beumer et al. (2008) PNAS 105(50):19821-19826.

Vectors may be provided directly to a target host cell. In other words, the cells are contacted with vectors comprising the subject nucleic acids (e.g., recombinant expression vectors having the donor template sequence and encoding the CRISPR/Cas guide RNA; recombinant expression vectors encoding the Class 2 CRISPR/Cas effector protein; etc.) such that the vectors are taken up by the cells. Methods for contacting cells with nucleic acid vectors that are plasmids, include electroporation, calcium chloride transfection, microinjection, and lipofection are well known in the art. For viral vector delivery, cells can be contacted with viral particles comprising the subject viral expression vectors.

Retroviruses, for example, lentiviruses, are suitable for use in methods of the present disclosure. Commonly used retroviral vectors are "defective", i.e. unable to produce viral proteins required for productive infection. Rather, replication of the vector requires growth in a packaging cell line. To generate viral particles comprising nucleic acids of interest, the retroviral nucleic acids comprising the nucleic acid are packaged into viral capsids by a packaging cell line. Different packaging cell lines provide a different envelope protein (ecotropic, amphotropic or xenotropic) to be incorporated into the capsid, this envelope protein determining the specificity of the viral particle for the cells (ecotropic for murine and rat; amphotropic for most mammalian cell types including human, dog and mouse; and xenotropic for most mammalian cell types except murine cells). The appropriate packaging cell line may be used to ensure that the cells are targeted by the packaged viral particles. Methods of introducing subject vector expression vectors into packaging cell lines and of collecting the viral particles that are generated by the packaging lines are well known in the art. Nucleic acids can also introduced by direct micro-injection (e.g., injection of RNA).

Vectors used for providing the nucleic acids encoding CRISPR/Cas guide RNA and/or a Class 2 CRISPR/Cas effector protein to a target host cell can include suitable promoters for driving the expression, that is, transcriptional activation, of the nucleic acid of interest. In other words, in some cases, the nucleic acid of interest will be operably linked to a promoter. This may include ubiquitously acting promoters, for example, the CMV-β-actin promoter, or inducible promoters, such as promoters that are active in particular cell populations or that respond to the presence of drugs such as tetracycline. By transcriptional activation, it is intended that transcription will be increased above basal levels in the target cell by 10 fold, by 100 fold, more usually by 1000 fold. In addition, vectors used for providing a nucleic acid encoding a CRISPR/Cas guide RNA and/or a Class 2 CRISPR/Cas effector protein to a cell may include nucleic acid sequences that encode for selectable markers in the target cells, so as to identify cells that have taken up the CRISPR/Cas guide RNA and/or Class 2 CRISPR/Cas effector protein.

A nucleic acid comprising a nucleotide sequence encoding a Class 2 CRISPR/Cas effector protein, or a Class 2 CRISPR/Cas effector fusion polypeptide, is in some cases an RNA. Thus, a Class 2 CRISPR/Cas effector fusion protein can be introduced into cells as RNA. Methods of introducing RNA into cells are known in the art and may include, for example, direct injection, transfection, or any other method used for the introduction of DNA. A Class 2 CRISPR/Cas effector protein may instead be provided to cells as a polypeptide. Such a polypeptide may optionally be fused to a polypeptide domain that increases solubility of the product. The domain may be linked to the polypeptide through a defined protease cleavage site, e.g. a TEV sequence, which is cleaved by TEV protease. The linker may also include one or more flexible sequences, e.g. from 1 to 10 glycine residues. In some embodiments, the cleavage of the fusion protein is performed in a buffer that maintains solubility of the product, e.g. in the presence of from 0.5 to 2 M urea, in the presence of polypeptides and/or polynucleotides that increase solubility, and the like. Domains of interest include endosomolytic domains, e.g. influenza HA domain; and other polypeptides that aid in production, e.g. IF2 domain, GST domain, GRPE domain, and the like. The polypeptide may be formulated for improved stability. For example, the peptides may be PEGylated, where the polyethyleneoxy group provides for enhanced lifetime in the blood stream.

Additionally or alternatively, a Class 2 CRISPR/Cas effector protein of the present disclosure may be fused to a polypeptide permeant domain to promote uptake by the cell. A number of permeant domains are known in the art and may be used in the non-integrating polypeptides of the present disclosure, including peptides, peptidomimetics, and non-peptide carriers. For example, a permeant peptide may be derived from the third alpha helix of *Drosophila melanogaster* transcription factor Antennapaedia, referred to as penetratin, which comprises the amino acid sequence RQIKIWFQNRRMKWKK (SEQ ID NO: 155). As another example, the permeant peptide comprises the HIV-1 tat basic region amino acid sequence, which may include, for example, amino acids 49-57 of naturally-occurring tat protein. Other permeant domains include poly-arginine motifs, for example, the region of amino acids 34-56 of HIV-1 rev protein, nona-arginine, octa-arginine, and the like. (See, for example, Futaki et al. (2003) Curr Protein Pept Sci. 2003 April; 4(2): 87-9 and 446; and Wender et al. (2000) Proc. Natl. Acad. Sci. U.S.A 2000 Nov. 21; 97(24):13003-8; published U.S. Patent applications 20030220334; 20030083256; 20030032593; and 20030022831, herein specifically incorporated by reference for the teachings of translocation peptides and peptoids). The nona-arginine (R9) sequence is one of the more efficient PTDs that have been characterized (Wender et al. 2000; Uemura et al. 2002). The site at which the fusion is made may be selected in order to optimize the biological activity, secretion or binding characteristics of the polypeptide. The optimal site will be determined by routine experimentation.

A Class 2 CRISPR/Cas effector protein of the present disclosure may be produced in vitro or by eukaryotic cells or by prokaryotic cells, and it may be further processed by unfolding, e.g. heat denaturation, dithiothreitol reduction, etc. and may be further refolded, using methods known in the art.

Modifications of interest that do not alter primary sequence include chemical derivatization of polypeptides, e.g., acylation, acetylation, carboxylation, amidation, etc. Also included are modifications of glycosylation, e.g. those made by modifying the glycosylation patterns of a polypeptide during its synthesis and processing or in further processing steps; e.g. by exposing the polypeptide to enzymes which affect glycosylation, such as mammalian glycosylating or deglycosylating enzymes. Also embraced are sequences that have phosphorylated amino acid residues, e.g. phosphotyrosine, phosphoserine, or phosphothreonine.

Also suitable for inclusion in embodiments of the present disclosure are nucleic acids (e.g., encoding a CRISPR/Cas guide RNA, encoding a Class 2 CRISPR/Cas effector fusion protein, etc.) and proteins (e.g., a Class 2 CRISPR/Cas effector fusion protein derived from a wild type protein or a variant protein) that have been modified using ordinary molecular biological techniques and synthetic chemistry so as to improve their resistance to proteolytic degradation, to change the target sequence specificity, to optimize solubility properties, to alter protein activity (e.g., transcription modulatory activity, enzymatic activity, etc.) or to render them more suitable. Analogs of such polypeptides include those containing residues other than naturally occurring L-amino acids, e.g. D-amino acids or non-naturally occurring synthetic amino acids. D-amino acids may be substituted for some or all of the amino acid residues.

A Class 2 CRISPR/Cas effector protein of the present disclosure may be prepared by in vitro synthesis, using conventional methods as known in the art. Various commercial synthetic apparatuses are available, for example, automated synthesizers by Applied Biosystems, Inc., Beckman, etc. By using synthesizers, naturally occurring amino acids may be substituted with unnatural amino acids. The particular sequence and the manner of preparation will be determined by convenience, economics, purity required, and the like.

If desired, various groups may be introduced into the peptide during synthesis or during expression, which allow for linking to other molecules or to a surface. Thus cysteines can be used to make thioethers, histidines for linking to a metal ion complex, carboxyl groups for forming amides or esters, amino groups for forming amides, and the like.

A Class 2 CRISPR/Cas effector protein of the present disclosure may also be isolated and purified in accordance with conventional methods of recombinant synthesis. A lysate may be prepared of the expression host and the lysate purified using high performance liquid chromatography (HPLC), exclusion chromatography, gel electrophoresis, affinity chromatography, or other purification technique. For the most part, the compositions which are used will comprise 20% or more by weight of the desired product, more usually 75% or more by weight, preferably 95% or more by weight, and for therapeutic purposes, usually 99.5% or more by weight, in relation to contaminants related to the method of preparation of the product and its purification. Usually, the percentages will be based upon total protein. Thus, in some cases, a Class 2 CRISPR/Cas effector protein, or a Class 2 CRISPR/Cas effector fusion polypeptide, of the present disclosure is at least 80% pure, at least 85% pure, at least 90% pure, at least 95% pure, at least 98% pure, or at least 99% pure (e.g., free of contaminants, non-Class 2 CRISPR/Cas effector proteins or other macromolecules, etc.).

To induce cleavage or any desired modification to a target nucleic acid (e.g., genomic DNA), or any desired modification to a polypeptide associated with target nucleic acid, the CRISPR/Cas guide RNA and/or the Class 2 CRISPR/Cas effector protein and/or the CRISPR/Cas trancRNA, and/or the donor template sequence, whether they be introduced as nucleic acids or polypeptides, can be provided to the cells for about 30 minutes to about 24 hours, e.g., 1 hour, 1.5 hours, 2 hours, 2.5 hours, 3 hours, 3.5 hours 4 hours, 5 hours, 6 hours, 7 hours, 8 hours, 12 hours, 16 hours, 18 hours, 20 hours, or any other period from about 30 minutes to about 24 hours, which may be repeated with a frequency of about every day to about every 4 days, e.g., every 1.5 days, every 2 days, every 3 days, or any other frequency from about every day to about every four days. The agent(s) may be provided to the subject cells one or more times, e.g. one time, twice, three times, or more than three times, and the cells allowed to incubate with the agent(s) for some amount of time following each contacting event e.g. 16-24 hours, after which time the media is replaced with fresh media and the cells are cultured further.

In cases in which two or more different targeting complexes are provided to the cell (e.g., two different CRISPR/Cas guide RNAs that are complementary to different sequences within the same or different target nucleic acid), the complexes may be provided simultaneously (e.g. as two polypeptides and/or nucleic acids), or delivered simultaneously. Alternatively, they may be provided consecutively, e.g. the targeting complex being provided first, followed by the second targeting complex, etc. or vice versa.

To improve the delivery of a DNA vector into a target cell, the DNA can be protected from damage and its entry into the cell facilitated, for example, by using lipoplexes and polyplexes. Thus, in some cases, a nucleic acid of the present disclosure (e.g., a recombinant expression vector of the present disclosure) can be covered with lipids in an organized structure like a micelle or a liposome. When the organized structure is complexed with DNA it is called a lipoplex. There are three types of lipids, anionic (negatively-charged), neutral, or cationic (positively-charged). Lipoplexes that utilize cationic lipids have proven utility for gene transfer. Cationic lipids, due to their positive charge, naturally complex with the negatively charged DNA. Also as a result of their charge, they interact with the cell membrane. Endocytosis of the lipoplex then occurs, and the DNA is released into the cytoplasm. The cationic lipids also protect against degradation of the DNA by the cell.

Complexes of polymers with DNA are called polyplexes. Most polyplexes consist of cationic polymers and their production is regulated by ionic interactions. One large difference between the methods of action of polyplexes and lipoplexes is that polyplexes cannot release their DNA load into the cytoplasm, so to this end, co-transfection with endosome-lytic agents (to lyse the endosome that is made during endocytosis) such as inactivated adenovirus must occur. However, this is not always the case; polymers such as polyethylenimine have their own method of endosome disruption as does chitosan and trimethylchitosan.

Dendrimers, a highly branched macromolecule with a spherical shape, may be also be used to genetically modify stem cells. The surface of the dendrimer particle may be functionalized to alter its properties. In particular, it is possible to construct a cationic dendrimer (i.e., one with a positive surface charge). When in the presence of genetic material such as a DNA plasmid, charge complementarity leads to a temporary association of the nucleic acid with the cationic dendrimer. On reaching its destination, the dendrimer-nucleic acid complex can be taken up into a cell by endocytosis.

In some cases, a nucleic acid of the disclosure (e.g., an expression vector) includes an insertion site for a guide sequence of interest. For example, a nucleic acid can include an insertion site for a guide sequence of interest, where the insertion site is immediately adjacent to a nucleotide sequence encoding the portion of a CRISPR/Cas guide RNA that does not change when the guide sequence is changed to hybrized to a desired target sequence (e.g., sequences that contribute to the protein binding aspect of the guide RNA, e.g, the sequences that contribute to the dsRNA duplex(es) of the CRISPR/Cas guide RNA—this portion of the guide RNA can also be referred to as the 'scaffold' or 'constant region' of the guide RNA). Thus, in some cases, a subject nucleic acid (e.g., an expression vector) includes a nucleotide sequence encoding a CRISPR/Cas guide RNA, except that the portion encoding the guide sequence portion of the guide RNA is an insertion sequence (an insertion site). An insertion site is any nucleotide sequence used for the insertion of a the desired sequence. "Insertion sites" for use with various technologies are known to those of ordinary skill in the art and any convenient insertion site can be used. An insertion site can be for any method for manipulating nucleic acid sequences. For example, in some cases the insertion site is a multiple cloning site (MCS) (e.g., a site including one or more restriction enzyme recognition sequences), a site for ligation independent cloning, a site for recombination based cloning (e.g., recombination based on att sites), a nucleotide sequence recognized by a CRISPR/Cas (e.g. Cas9) based technology, and the like.

An insertion site can be any desirable length, and can depend on the type of insertion site (e.g., can depend on whether (and how many) the site includes one or more restriction enzyme recognition sequences, whether the site includes a target site for a CRISPR/Cas protein, etc.). In some cases, an insertion site of a subject nucleic acid is 3 or more nucleotides (nt) in length (e.g., 5 or more. 8 or more, 10 or more, 15 or more, 17 or more, 18 or more, 19 or more, 20 or more or 25 or more, or 30 or more nt in length). In some cases, the length of an insertion site of a subject nucleic acid has a length in a range of from 2 to 50 nucleotides (nt) (e.g., from 2 to 40 nt, from 2 to 30 nt, from 2 to 25 nt, from 2 to 20 nt, from 5 to 50 nt, from 5 to 40 nt, from 5 to 30 nt, from 5 to 25 nt, from 5 to 20 nt, from 10 to 50 nt, from 10 to 40 nt, from 10 to 30 nt, from 10 to 25 nt, from 10 to 20 nt, from 17 to 50 nt, from 17 to 40 nt, from 17 to 30 nt, from 17 to 25 nt). In some cases, the length of an insertion site of a subject nucleic acid has a length in a range of from 5 to 40 nt.

Nucleic Acid Modifications

In some embodiments, a subject nucleic acid (e.g., a CRISPR/Cas guide RNA or trancRNA) has one or more modifications, e.g., a base modification, a backbone modification, etc., to provide the nucleic acid with a new or enhanced feature (e.g., improved stability). A nucleoside is a base-sugar combination. The base portion of the nucleoside is normally a heterocyclic base. The two most common classes of such heterocyclic bases are the purines and the pyrimidines. Nucleotides are nucleosides that further include a phosphate group covalently linked to the sugar portion of the nucleoside. For those nucleosides that include a pentofuranosyl sugar, the phosphate group can be linked to the 2', the 3', or the 5' hydroxyl moiety of the sugar. In forming oligonucleotides, the phosphate groups covalently link adjacent nucleosides to one another to form a linear polymeric compound. In turn, the respective ends of this linear polymeric compound can be further joined to form a circular compound, however, linear compounds are suitable. In addition, linear compounds may have internal nucleotide base complementarity and may therefore fold in a manner as to produce a fully or partially double-stranded compound. Within oligonucleotides, the phosphate groups are commonly referred to as forming the internucleoside backbone of the oligonucleotide. The normal linkage or backbone of RNA and DNA is a 3' to 5' phosphodiester linkage.

Suitable nucleic acid modifications include, but are not limited to: 2'Omethyl modified nucleotides, 2' Fluoro modified nucleotides, locked nucleic acid (LNA) modified nucleotides, peptide nucleic acid (PNA) modified nucleotides, nucleotides with phosphorothioate linkages, and a 5' cap (e.g., a 7-methylguanylate cap (m7G)). Additional details and additional modifications are described below.

A 2'-O-Methyl modified nucleotide (also referred to as 2'-O-Methyl RNA) is a naturally occurring modification of RNA found in tRNA and other small RNAs that arises as a post-transcriptional modification. Oligonucleotides can be directly synthesized that contain 2'-O-Methyl RNA. This modification increases Tm of RNA:RNA duplexes but results in only small changes in RNA:DNA stability. It is stabile with respect to attack by single-stranded ribonucleases and is typically 5 to 10-fold less susceptible to DNases than DNA. It is commonly used in antisense oligos as a means to increase stability and binding affinity to the target message.

2' Fluoro modified nucleotides (e.g., 2' Fluoro bases) have a fluorine modified ribose which increases binding affinity (Tm) and also confers some relative nuclease resistance when compared to native RNA. These modifications are commonly employed in ribozymes and siRNAs to improve stability in serum or other biological fluids.

LNA bases have a modification to the ribose backbone that locks the base in the C3'-endo position, which favors RNA A-type helix duplex geometry. This modification significantly increases Tm and is also very nuclease resistant. Multiple LNA insertions can be placed in an oligo at any position except the 3'-end. Applications have been described ranging from antisense oligos to hybridization probes to SNP detection and allele specific PCR. Due to the large increase in Tm conferred by LNAs, they also can cause an increase in primer dimer formation as well as self-hairpin formation. In some cases, the number of LNAs incorporated into a single oligo is 10 bases or less.

The phosphorothioate (PS) bond (i.e., a phosphorothioate linkage) substitutes a sulfur atom for a non-bridging oxygen in the phosphate backbone of a nucleic acid (e.g., an oligo). This modification renders the internucleotide linkage resistant to nuclease degradation. Phosphorothioate bonds can be introduced between the last 3-5 nucleotides at the 5'- or 3'-end of the oligo to inhibit exonuclease degradation. Including phosphorothioate bonds within the oligo (e.g., throughout the entire oligo) can help reduce attack by endonucleases as well.

In some embodiments, a subject nucleic acid has one or more nucleotides that are 2'-O-Methyl modified nucleotides. In some embodiments, a subject nucleic acid (e.g., a dsRNA, a siNA, etc.) has one or more 2' Fluoro modified nucleotides. In some embodiments, a subject nucleic acid (e.g., a dsRNA, a siNA, etc.) has one or more LNA bases. In some embodiments, a subject nucleic acid (e.g., a dsRNA, a siNA, etc.) has one or more nucleotides that are linked by a phosphorothioate bond (i.e., the subject nucleic acid has one or more phosphorothioate linkages). In some embodiments, a subject nucleic acid (e.g., a dsRNA, a siNA, etc.) has a 5' cap (e.g., a 7-methylguanylate cap (m7G)). In some embodiments, a subject nucleic acid (e.g., a dsRNA, a siNA, etc.) has a combination of modified nucleotides. For example, a subject nucleic acid (e.g., a dsRNA, a siNA, etc.) can have a 5' cap (e.g., a 7-methylguanylate cap (m7G)) in addition to having one or more nucleotides with other modifications (e.g., a 2'-O-Methyl nucleotide and/or a 2' Fluoro modified nucleotide and/or a LNA base and/or a phosphorothioate linkage).

Modified Backbones and Modified Internucleoside Linkages

Examples of suitable nucleic acids (e.g., a CRISPR/Cas guide RNA and/or CRISPR/Cas trancRNA) containing modifications include nucleic acids containing modified backbones or non-natural internucleoside linkages. Nucleic acids having modified backbones include those that retain a phosphorus atom in the backbone and those that do not have a phosphorus atom in the backbone.

Suitable modified oligonucleotide backbones containing a phosphorus atom therein include, for example, phosphorothioates, chiral phosphorothioates, phosphorodithioates, phosphotriesters, aminoalkylphosphotriesters, methyl and other alkyl phosphonates including 3'-alkylene phosphonates, 5'-alkylene phosphonates and chiral phosphonates, phosphinates, phosphoramidates including 3'-amino phosphoramidate and aminoalkylphosphoramidates, phosphorodiamidates, thionophosphoramidates, thionoalkylphosphonates, thionoalkylphosphotriesters, selenophosphates and boranophosphates having normal 3'-5' linkages, 2'-5' linked analogs of these, and those having inverted polarity wherein one or more internucleotide linkages is a 3' to 3', 5' to 5' or 2' to 2' linkage. Suitable oligonucleotides having inverted polarity comprise a single 3' to 3' linkage at the 3'-most internucleotide linkage i.e. a single inverted nucleoside residue which may be a basic (the nucleobase is missing or has a hydroxyl group in place thereof). Various salts (such as, for example, potassium or sodium), mixed salts and free acid forms are also included.

In some embodiments, a subject nucleic acid comprises one or more phosphorothioate and/or heteroatom internucleoside linkages, in particular—$CH_2$—NH—O—$CH_2$—, —$CH_2$—$N(CH_3)$—O—$CH_2$— (known as a methylene (methylimino) or MMI backbone), —$CH_2$—O—N($CH_3$)—$CH_2$—, —$CH_2$—$N(CH_3)$—$N(CH_3)$—$CH_2$— and —O—$N(CH_3)$—$CH_2$—$CH_2$— (wherein the native phosphodiester internucleotide linkage is represented as —O—P(=O)(OH)—O—$CH_2$—). MMI type internucleoside linkages are disclosed in the above referenced U.S. Pat. No. 5,489,677, the disclosure of which is incorporated herein by reference in its entirety. Suitable amide internucleoside linkages are disclosed in U.S. Pat. No. 5,602,240, the disclosure of which is incorporated herein by reference in its entirety.

Also suitable are nucleic acids having morpholino backbone structures as described in, e.g., U.S. Pat. No. 5,034,506. For example, in some embodiments, a subject nucleic acid comprises a 6-membered morpholino ring in place of a ribose ring. In some of these embodiments, a phosphorodiamidate or other non-phosphodiester internucleoside linkage replaces a phosphodiester linkage.

Suitable modified polynucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; riboacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Mimetics

A subject nucleic acid can be a nucleic acid mimetic. The term "mimetic" as it is applied to polynucleotides is intended to include polynucleotides wherein only the furanose ring or both the furanose ring and the internucleotide linkage are replaced with non-furanose groups, replacement of only the furanose ring is also referred to in the art as being a sugar surrogate. The heterocyclic base moiety or a modified heterocyclic base moiety is maintained for hybridization with an appropriate target nucleic acid. One such nucleic acid, a polynucleotide mimetic that has been shown to have excellent hybridization properties, is referred to as a peptide nucleic acid (PNA). In PNA, the sugar-backbone of a polynucleotide is replaced with an amide containing backbone, in particular an aminoethylglycine backbone. The nucleotides are retained and are bound directly or indirectly to aza nitrogen atoms of the amide portion of the backbone.

One polynucleotide mimetic that has been reported to have excellent hybridization properties is a peptide nucleic acid (PNA). The backbone in PNA compounds is two or more linked aminoethylglycine units which gives PNA an amide containing backbone. The heterocyclic base moieties are bound directly or indirectly to aza nitrogen atoms of the amide portion of the backbone. Representative U.S. patents that describe the preparation of PNA compounds include, but are not limited to: U.S. Pat. Nos. 5,539,082; 5,714,331; and 5,719,262, the disclosures of which are incorporated herein by reference in their entirety.

Another class of polynucleotide mimetic that has been studied is based on linked morpholino units (morpholino nucleic acid) having heterocyclic bases attached to the morpholino ring. A number of linking groups have been reported that link the morpholino monomeric units in a morpholino nucleic acid. One class of linking groups has been selected to give a non-ionic oligomeric compound. The non-ionic morpholino-based oligomeric compounds are less likely to have undesired interactions with cellular proteins. Morpholino-based polynucleotides are non-ionic mimics of oligonucleotides which are less likely to form undesired interactions with cellular proteins (Dwaine A. Braasch and David R. Corey, Biochemistry, 2002, 41(14), 4503-4510). Morpholino-based polynucleotides are disclosed in U.S. Pat. No. 5,034,506, the disclosure of which is incorporated herein by reference in its entirety. A variety of compounds within the morpholino class of polynucleotides have been prepared, having a variety of different linking groups joining the monomeric subunits.

A further class of polynucleotide mimetic is referred to as cyclohexenyl nucleic acids (CeNA). The furanose ring normally present in a DNA/RNA molecule is replaced with a cyclohexenyl ring. CeNA DMT protected phosphoramidite monomers have been prepared and used for oligomeric compound synthesis following classical phosphoramidite chemistry. Fully modified CeNA oligomeric compounds and oligonucleotides having specific positions modified with CeNA have been prepared and studied (see Wang et al., *J. Am. Chem. Soc.*, 2000, 122, 8595-8602, the disclosure of which is incorporated herein by reference in its entirety). In general the incorporation of CeNA monomers into a DNA chain increases its stability of a DNA/RNA hybrid. CeNA oligoadenylates formed complexes with RNA and DNA complements with similar stability to the native complexes. The study of incorporating CeNA structures into natural nucleic acid structures was shown by NMR and circular dichroism to proceed with easy conformational adaptation.

A further modification includes Locked Nucleic Acids (LNAs) in which the 2'-hydroxyl group is linked to the 4' carbon atom of the sugar ring thereby forming a 2'-C,4'-C-oxymethylene linkage thereby forming a bicyclic sugar moiety. The linkage can be a methylene (—CH$_2$—), group bridging the 2' oxygen atom and the 4' carbon atom wherein n is 1 or 2 (Singh et al., *Chem. Commun.*, 1998, 4, 455-456, the disclosure of which is incorporated herein by reference in its entirety). LNA and LNA analogs display very high duplex thermal stabilities with complementary DNA and RNA (Tm=+3 to +10° C.), stability towards 3'-exonucleolytic degradation and good solubility properties. Potent and nontoxic antisense oligonucleotides containing LNAs have been described (e.g., Wahlestedt et al., Proc. Natl. Acad. Sci. U.S.A., 2000, 97, 5633-5638, the disclosure of which is incorporated herein by reference in its entirety).

The synthesis and preparation of the LNA monomers adenine, cytosine, guanine, 5-methylcytosine, thymine and uracil, along with their oligomerization, and nucleic acid recognition properties have been described (e.g., Koshkin et al., Tetrahedron, 1998, 54, 3607-3630, the disclosure of which is incorporated herein by reference in its entirety). LNAs and preparation thereof are also described in WO 98/39352 and WO 99/14226, as well as U.S. applications 20120165514, 20100216983, 20090041809, 20060117410, 20040014959, 20020094555, and 20020086998, the disclosures of which are incorporated herein by reference in their entirety.

Modified Sugar Moieties

A subject nucleic acid can also include one or more substituted sugar moieties. Suitable polynucleotides comprise a sugar substituent group selected from: OH; F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted C$_1$ to C$_{10}$ alkyl or C$_2$ to C$_{10}$ alkenyl and alkynyl. Particularly suitable are O((CH$_2$)$_n$O)$_m$CH$_3$, O(CH$_2$)$_n$OCH$_3$, O(CH$_2$)$_n$NH$_2$, O(CH$_2$)$_n$CH$_3$, O(CH$_2$)$_n$ONH$_2$, and O(CH$_2$)$_n$ON((CH$_2$)$_n$CH$_3$)$_2$, where n and m are from 1 to about 10. Other suitable polynucleotides comprise a sugar substituent group selected from: C$_1$ to C$_{10}$ lower alkyl, substituted lower alkyl, alkenyl, alkynyl, alkaryl, aralkyl, O-alkaryl or O-aralkyl, SH, SCH$_3$, OCN, Cl, Br, CN, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. A suitable modification includes 2'-methoxyethoxy (2'-O—CH$_2$ CH$_2$OCH$_3$, also known as 2'-O-(2-methoxyethyl) or 2'-MOE) (Martin et al., *Helv. Chim. Acta*, 1995, 78, 486-504, the disclosure of which is incorporated herein by reference in its entirety) i.e., an alkoxyalkoxy group. A further suitable modification includes 2'-dimethylaminooxyethoxy, i.e., a O(CH$_2$)$_2$ON(CH$_3$)$_2$ group, also known as 2'-DMAOE, as described in examples hereinbelow, and 2'-dimethylaminoethoxyethoxy (also known in the art as 2'-O-dimethyl-amino-ethoxy-ethyl or 2'-DMAEOE), i.e., 2'-O—CH$_2$—O—CH$_2$—N(CH$_3$)$_2$.

Other suitable sugar substituent groups include methoxy (—O—CH$_3$), aminopropoxy (—O CH$_2$ CH$_2$ CH$_2$NH$_2$), allyl (—CH$_2$—CH=CH$_2$), —O-allyl CH$_2$—CH=CH$_2$) and fluoro (F). 2'-sugar substituent groups may be in the arabino (up) position or ribo (down) position. A suitable 2'-arabino modification is 2'-F. Similar modifications may also be made at other positions on the oligomeric compound, particularly the 3' position of the sugar on the 3' terminal nucleoside or in 2'-5' linked oligonucleotides and the 5' position of 5' terminal nucleotide. Oligomeric compounds may also have sugar mimetics such as cyclobutyl moieties in place of the pentofuranosyl sugar.

Base Modifications and Substitutions

A subject nucleic acid may also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl (—C≡C—CH$_3$) uracil and cytosine and other alkynyl derivatives of pyrimidine bases, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 2-F-adenine, 2-amino-adenine, 8-azaguanine and 8-azaadenine, 7-deazaguanine and 7-deazaadenine and 3-deazaguanine and 3-deazaadenine. Further modified nucleobases include tricyclic pyrimidines such as phenoxazine cytidine(1H-pyrimido(5,4-b)(1,4)benzoxazin-2 (3H)-one), phenothiazine cytidine (1H-pyrimido(5,4-b)(1,4) benzothiazin-2(3H)-one), G-clamps such as a substituted phenoxazine cytidine (e.g. 9-(2-aminoethoxy)-H-pyrimido (5,4-(b) (1,4)benzoxazin-2(3H)-one), carbazole cytidine (2H-pyrimido(4,5-b)indol-2-one), pyridoindole cytidine (H-pyrido(3',2':4,5)pyrrolo(2,3-d)pyrimidin-2-one).

Heterocyclic base moieties may also include those in which the purine or pyrimidine base is replaced with other heterocycles, for example 7-deaza-adenine, 7-deazaguanosine, 2-aminopyridine and 2-pyridone. Further nucleobases include those disclosed in U.S. Pat. No. 3,687,808, those disclosed in *The Concise Encyclopedia Of Polymer Science And Engineering*, pages 858-859, Kroschwitz, J. I., ed. John Wiley & Sons, 1990, those disclosed by Englisch et al., *Angewandte Chemie, International Edition*, 1991, 30, 613, and those disclosed by Sanghvi, Y. S., Chapter 15, *Antisense Research and Applications*, pages 289-302, Crooke, S. T. and Lebleu, B., ed., CRC Press, 1993; the disclosures of which are incorporated herein by reference in their entirety. Certain of these nucleobases are useful for increasing the binding affinity of an oligomeric compound. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi et al., eds., Antisense Research and Applications, CRC Press, Boca Raton, 1993, pp. 276-278; the disclosure of which is incorporated herein by reference in its entirety) and are suitable base substitutions, e.g., when combined with 2'-O-methoxyethyl sugar modifications.

Conjugates

Another possible modification of a subject nucleic acid involves chemically linking to the polynucleotide one or more moieties or conjugates which enhance the activity, cellular distribution or cellular uptake of the oligonucleotide. These moieties or conjugates can include conjugate groups covalently bound to functional groups such as primary or secondary hydroxyl groups. Conjugate groups include, but are not limited to, intercalators, reporter molecules, polyamines, polyamides, polyethylene glycols, polyethers, groups that enhance the pharmacodynamic properties of oligomers, and groups that enhance the pharmacokinetic properties of oligomers. Suitable conjugate groups include, but are not limited to, cholesterols, lipids, phospholipids, biotin, phenazine, folate, phenanthridine, anthraquinone, acridine, fluoresceins, rhodamines, coumarins, and dyes. Groups that enhance the pharmacodynamic properties include groups that improve uptake, enhance resistance to degradation, and/or strengthen sequence-specific hybridization with the target nucleic acid. Groups that enhance the pharmacokinetic properties include groups that improve uptake, distribution, metabolism or excretion of a subject nucleic acid.

Conjugate moieties include but are not limited to lipid moieties such as a cholesterol moiety (Letsinger et al., *Proc. Natl. Acad. Sci. USA,* 1989, 86, 6553-6556), cholic acid (Manoharan et al., *Bioorg. Med. Chem. Let.,* 1994, 4, 1053-1060), a thioether, e.g., hexyl-S-tritylthiol (Manoharan et al., *Ann. N.Y. Acad. Sci.,* 1992, 660, 306-309; Manoharan et al., *Bioorg. Med. Chem. Let.,* 1993, 3, 2765-2770), a thiocholesterol (Oberhauser et al., *Nucl. Acids Res.,* 1992, 20, 533-538), an aliphatic chain, e.g., dodecandiol or undecyl residues (Saison-Behmoaras et al., *EMBO J.,* 1991, 10, 1111-1118; Kabanov et al., *FEBS Lett.,* 1990, 259, 327-330; Svinarchuk et al., *Biochimie,* 1993, 75, 49-54), a phospholipid, e.g., di-hexadecyl-rac-glycerol or triethylammonium 1,2-di-O-hexadecyl-rac-glycero-3-H-phosphonate (Manoharan et al., *Tetrahedron Lett.,* 1995, 36, 3651-3654; Shea et al., *Nucl. Acids Res.,* 1990, 18, 3777-3783), a polyamine or a polyethylene glycol chain (Manoharan et al., *Nucleosides & Nucleotides,* 1995, 14, 969-973), or adamantane acetic acid (Manoharan et al., *Tetrahedron Lett.,* 1995, 36, 3651-3654), a palmityl moiety (Mishra et al., *Biochim. Biophys. Acta,* 1995, 1264, 229-237), or an octadecylamine or hexylamino-carbonyl-oxycholesterol moiety (Crooke et al., *J. Pharmacol. Exp. Ther.,* 1996, 277, 923-937).

A conjugate may include a "Protein Transduction Domain" or PTD (also known as a CPP—cell penetrating peptide), which may refer to a polypeptide, polynucleotide, carbohydrate, or organic or inorganic compound that facilitates traversing a lipid bilayer, micelle, cell membrane, organelle membrane, or vesicle membrane. A PTD attached to another molecule, which can range from a small polar molecule to a large macromolecule and/or a nanoparticle, facilitates the molecule traversing a membrane, for example going from extracellular space to intracellular space, or cytosol to within an organelle (e.g., the nucleus). In some embodiments, a PTD is covalently linked to the 3' end of an exogenous polynucleotide. In some embodiments, a PTD is covalently linked to the 5' end of an exogenous polynucleotide. Exemplary PTDs include but are not limited to a minimal undecapeptide protein transduction domain (corresponding to residues 47-57 of HIV-1 TAT comprising YGRKKRRQRRR; SEQ ID NO: 151); a polyarginine sequence comprising a number of arginines sufficient to direct entry into a cell (e.g., 3, 4, 5, 6, 7, 8, 9, 10, or 10-50 arginines); a VP22 domain (Zender et al. (2002) *Cancer Gene Ther.* 9(6):489-96); an *Drosophila* Antennapedia protein transduction domain (Noguchi et al. (2003) *Diabetes* 52(7):1732-1737); a truncated human calcitonin peptide (Trehin et al. (2004) *Pharm. Research* 21:1248-1256); polylysine (Wender et al. (2000) *Proc. Natl. Acad. Sci. USA* 97:13003-13008); RRQRRTSKLMKR SEQ ID NO: 152); Transportan GWTLNSAGYLLGKINLKALAALAKKIL SEQ ID NO: 153); KALAWEAKLAKALAKA-LAKHLAKALAKALKCEA SEQ ID NO: 154); and RQIKIWFQNRRMKWKK SEQ ID NO: 155). Exemplary PTDs include but are not limited to, YGRKKRRQRRR SEQ ID NO: 151), RKKRRQRRR SEQ ID NO: 157); an arginine homopolymer of from 3 arginine residues to 50 arginine residues; Exemplary PTD domain amino acid sequences include, but are not limited to, any of the following: YGRKKRRQRRR SEQ ID NO: 151); RKKRRQRR SEQ ID NO: 159); YARAAARQARA SEQ ID NO: 160); THRL-PRRRRRR SEQ ID NO: 161); and GGRRARRRRRR SEQ ID NO: 162). In some embodiments, the PTD is an activatable CPP (ACPP) (Aguilera et al. (2009) *Integr Biol (Camb)* June; 1(5-6): 371-381). ACPPs comprise a polycationic CPP (e.g., Arg9 or "R9") connected via a cleavable linker to a matching polyanion (e.g., Glu9 or "E9"), which reduces the net charge to nearly zero and thereby inhibits adhesion and uptake into cells. Upon cleavage of the linker, the polyanion is released, locally unmasking the polyarginine and its inherent adhesiveness, thus "activating" the ACPP to traverse the membrane.

Introducing Components into a Target Cell

A CRISPR/Cas guide RNA (or a nucleic acid comprising a nucleotide sequence encoding same) and/or a Class 2 CRISPR/Cas effector protein (or a nucleic acid comprising a nucleotide sequence encoding same) and/or a CRISPR/Cas trancRNA (or a nucleic acid that includes a nucleotide sequence encoding same) and/or a donor polynucleotide (donor template) can be introduced into a host cell by any of a variety of well-known methods.

Any of a variety of compounds and methods can be used to deliver to a target cell a Class 2 CRISPR/Cas system of the present disclosure. As a non-limiting example, a Class 2 CRISPR/Cas system of the present disclosure can be combined with a lipid. As another non-limiting example, a Class 2 CRISPR/Cas system of the present disclosure can be combined with a particle, or formulated into a particle.

Methods of introducing a nucleic acid into a host cell are known in the art, and any convenient method can be used to introduce a subject nucleic acid (e.g., an expression construct/vector) into a target cell (e.g., prokaryotic cell, eukaryotic cell, plant cell, animal cell, mammalian cell, human cell, and the like). Suitable methods include, e.g., viral infection, transfection, conjugation, protoplast fusion, lipofection, electroporation, calcium phosphate precipitation, polyethyleneimine (PEI)-mediated transfection, DEAE-dextran mediated transfection, liposome-mediated transfection, particle gun technology, calcium phosphate precipitation, direct micro injection, nanoparticle-mediated nucleic acid delivery (see, e.g., Panyam et., al Adv Drug Deliv Rev. 2012 Sep. 13. pii: 50169-409X(12)00283-9. doi: 10.1016/j.addr.2012.09.023), and the like.

In some cases, a Class 2 CRISPR/Cas effector protein of the present disclosure (e.g., wild type protein, variant protein, chimeric/fusion protein, dEffector, etc.) is provided as a nucleic acid (e.g., an mRNA, a DNA, a plasmid, an expression vector, a viral vector, etc.) that encodes the Class 2 CRISPR/Cas effector protein. In some cases, the Class 2 CRISPR/Cas effector protein of the present disclosure is provided directly as a protein (e.g., without an associated guide RNA or with an associate guide RNA, i.e., as a ribonucleoprotein complex). A Class 2 CRISPR/Cas effector protein of the present disclosure can be introduced into a cell (provided to the cell) by any convenient method; such methods are known to those of ordinary skill in the art. As an illustrative example, a Class 2 CRISPR/Cas effector protein of the present disclosure can be injected directly into a cell (e.g., with or without a CRISPR/Cas guide RNA or nucleic acid encoding a CRISPR/Cas guide RNA, and with or without a donor polynucleotide and with or without a CRISPR/Cas trancRNA). As another example, a preformed complex of a Class 2 CRISPR/Cas effector protein of the present disclosure and a CRISPR/Cas guide RNA (an RNP) can be introduced into a cell (e.g, eukaryotic cell) (e.g., via injection, via nucleofection; via a protein transduction domain (PTD) conjugated to one or more components, e.g., conjugated to the Class 2 CRISPR/Cas effector protein, conjugated to a guide RNA, conjugated to a CRISPR/Cas trancRNA, conjugated to a Class 2 CRISPR/Cas effector protein of the present disclosure and a guide RNA; etc.).

In some cases, a nucleic acid (e.g., a CRISPR/Cas guide RNA and/or a nucleic acid encoding it, a nucleic acid encoding a Class 2 CRISPR/Cas effector protein, a CRISPR/Cas trancRNA and/or a nucleic acid encoding it, and the like) and/or a polypeptide (e.g., a Class 2 CRISPR/Cas effector protein; a Class 2 CRISPR/Cas effector fusion polypeptide) is delivered to a cell (e.g., a target host cell) in a particle, or associated with a particle. In some cases, a Class 2 CRISPR/Cas system of the present disclosure is delivered to a cell in a particle, or associated with a particle. The terms "particle" and "nanoparticle" can be used interchangeably, as appropriate. For example, a recombinant expression vector comprising a nucleotide sequence encoding a Class 2 CRISPR/Cas effector protein of the present disclosure and/or a CRISPR/Cas guide RNA, an mRNA comprising a nucleotide sequence encoding a Class 2 CRISPR/Cas effector protein of the present disclosure, and guide RNA may be delivered simultaneously using particles or lipid envelopes; for instance, a Class 2 CRISPR/Cas effector protein and/or a CRISPR/Cas guide RNA and/or a trancRNA, e.g., as a complex (e.g., a ribonucleoprotein (RNP) complex), can be delivered via a particle, e.g., a delivery particle comprising lipid or lipidoid and hydrophilic polymer, e.g., a cationic lipid and a hydrophilic polymer, for instance wherein the cationic lipid comprises 1,2-dioleoyl-3-trimethylammonium-propane (DOTAP) or 1,2-ditetradecanoyl-sn-glycero-3-phosphocholine (DMPC) and/or wherein the hydrophilic polymer comprises ethylene glycol or polyethylene glycol (PEG); and/or wherein the particle further comprises cholesterol (e.g., particle from formulation 1=DOTAP 100, DMPC 0, PEG 0, Cholesterol 0; formulation number 2=DOTAP 90, DMPC 0, PEG 10, Cholesterol 0; formulation number 3=DOTAP 90, DMPC 0, PEG 5, Cholesterol 5). For example, a particle can be formed using a multistep process in which a Class 2 CRISPR/Cas effector protein and a CRISPR/Cas guide RNA are mixed together, e.g., at a 1:1 molar ratio, e.g., at room temperature, e.g., for 30 minutes, e.g., in sterile, nuclease free 1×phosphate-buffered saline (PBS); and separately, DOTAP, DMPC, PEG, and cholesterol as applicable for the formulation are dissolved in alcohol, e.g., 100% ethanol; and, the two solutions are mixed together to form particles containing the complexes).

A Class 2 CRISPR/Cas effector protein of the present disclosure (or an mRNA comprising a nucleotide sequence encoding a Class 2 CRISPR/Cas effector protein of the present disclosure; or a recombinant expression vector comprising a nucleotide sequence encoding a Class 2 CRISPR/Cas effector protein of the present disclosure) and/or CRISPR/Cas guide RNA (or a nucleic acid such as one or more expression vectors encoding the CRISPR/Cas guide RNA) may be delivered simultaneously using particles or lipid envelopes. For example, a biodegradable core-shell structured nanoparticle with a poly (β-amino ester) (PBAE) core enveloped by a phospholipid bilayer shell can be used. In some cases, particles/nanoparticles based on self assembling bioadhesive polymers are used; such particles/nanoparticles may be applied to oral delivery of peptides, intravenous delivery of peptides and nasal delivery of peptides, e.g., to the brain. Other embodiments, such as oral absorption and ocular delivery of hydrophobic drugs are also contemplated. A molecular envelope technology, which involves an engineered polymer envelope which is protected and delivered to the site of the disease, can be used. Doses of about 5 mg/kg can be used, with single or multiple doses, depending on various factors, e.g., the target tissue.

Lipidoid compounds (e.g., as described in US patent application 20110293703) are also useful in the administration of polynucleotides, and can be used to deliver a Class 2 CRISPR/Cas effector protein of the present disclosure, a Class 2 CRISPR/Cas effector fusion polypeptide of the present disclosure, an RNP of the present disclosure, a nucleic acid of the present disclosure, or a Class 2 CRISPR/Cas system of the present disclosure. In one aspect, the aminoalcohol lipidoid compounds are combined with an agent to be delivered to a cell or a subject to form microparticles, nanoparticles, liposomes, or micelles. The aminoalcohol lipidoid compounds may be combined with other aminoalcohol lipidoid compounds, polymers (synthetic or natural), surfactants, cholesterol, carbohydrates, proteins, lipids, etc. to form the particles. These particles may then optionally be combined with a pharmaceutical excipient to form a pharmaceutical composition.

A poly(beta-amino alcohol) (PBAA) can be used to deliver a Class 2 CRISPR/Cas effector protein of the present disclosure, a Class 2 CRISPR/Cas effector fusion polypeptide of the present disclosure, an RNP of the present disclosure, a nucleic acid of the present disclosure (e.g., a CRISPR/Cas guide RNA and/or a CRISPR/Cas trancRNA), or a Class 2 CRISPR/Cas system of the present disclosure, to a target cell. US Patent Publication No. 20130302401 relates to a class of poly(beta-amino alcohols) (PBAAs) that has been prepared using combinatorial polymerization.

Sugar-based particles may be used, for example GalNAc, as described with reference to WO2014118272 (incorporated herein by reference) and Nair, J K et al., 2014, Journal of the American Chemical Society 136 (49). 16958-16961) can be used to deliver a Class 2 CRISPR/Cas effector protein of the present disclosure, a Class 2 CRISPR/Cas effector fusion polypeptide of the present disclosure, an RNP of the present disclosure, a nucleic acid of the present disclosure, or a Class 2 CRISPR/Cas system of the present disclosure, to a target cell.

In some cases, lipid nanoparticles (LNPs) are used to deliver a Class 2 CRISPR/Cas effector protein of the present disclosure, a Class 2 CRISPR/Cas effector fusion polypeptide of the present disclosure, an RNP of the present disclosure, a nucleic acid of the present disclosure (e.g., a CRISPR/Cas guide RNA and/or a CRISPR/Cas trancRNA), or a Class 2 CRISPR/Cas system of the present disclosure, to a target cell. Negatively charged polymers such as RNA may be loaded into LNPs at low pH values (e.g., pH 4) where the ionizable lipids display a positive charge. However, at physiological pH values, the LNPs exhibit a low surface charge compatible with longer circulation times. Four species of ionizable cationic lipids have been focused upon, namely 1,2-dilineoyl-3-dimethylammonium-propane (DLinDAP), 1,2-dilinoleyloxy-3-N,N-dimethylaminopropane (DLinDMA), 1,2-dilinoleyloxy-keto-N,N-dimethyl-3- aminopropane (DLinKDMA), and 1,2-dilinoleyl-4-(2-dimethylaminoethyl)-[1,3]-dioxolane (DLinKC2-DMA). Preparation of LNPs and is described in, e.g., Rosin et al. (2011) Molecular Therapy 19:1286-2200). The cationic lipids 1,2-dilineoyl-3-dimethylammonium-propane (DLinDAP), 1,2-dilinoleyloxy-3-N,N-dimethylaminopropane (DLinDMA), 1,2-dilinoleyloxyketo-N,N-dimethyl-3-aminopropane (DLinK-DMA), 1,2-dilinoleyl-4-(2-dimethylaminoethyl)-[1,3]-dioxolane (DLinKC2-DMA), (3-o-[2"-(methoxypolyethyleneglycol 2000) succinoyl]-1,2-dimyristoyl-sn-glycol (PEG-S-DMG), and R-3-[(.omega.-methoxy-poly(ethylene glycol)2000) carbamoyl]-1,2-dimyristyloxlpropyl-3-amine (PEG-C-DOMG) may be used. A nucleic acid (e.g., a CRISPR/Cas guide RNA; a nucleic acid of the present disclosure; etc.) may be encapsulated in LNPs containing DLinDAP, DLinDMA, DLinK-DMA, and DLinKC2-DMA (cationic lipid:DSPC:CHOL: PEGS-DMG or PEG-C-DOMG at 40:10:40:10 molar ratios). In some cases, 0.2% SP-DiOC18 is incorporated.

Spherical Nucleic Acid (SNA™) constructs and other nanoparticles (particularly gold nanoparticles) can be used to deliver a Class 2 CRISPR/Cas effector protein of the present disclosure, a Class 2 CRISPR/Cas effector fusion polypeptide of the present disclosure, an RNP of the present disclosure, a nucleic acid of the present disclosure (e.g., a CRISPR/Cas guide RNA and/or a CRISPR/Cas trancRNA), or a Class 2 CRISPR/Cas system of the present disclosure, to a target cell. Sec, e.g., Cutler et al., J. Am. Chem. Soc. 2011 133:9254-9257, Hao et al., Small. 2011 7:3158-3162, Zhang et al., ACS Nano. 2011 5:6962-6970, Cutler et al., J. Am. Chem. Soc. 2012 134:1376-1391, Young et al., Nano Lett. 2012 12:3867-71, Zheng et al., Proc. Natl. Acad. Sci. USA. 2012 109:11975-80, Mirkin, Nanomedicine 2012 7:635-638 Zhang et al., J. Am. Chem. Soc. 2012 134:16488-1691, Weintraub, Nature 2013 495:S14-S16, Choi et al., Proc. Natl. Acad. Sci. USA. 2013 110(19): 7625-7630, Jensen et al., Sci. Transl. Med. 5, 209ra152 (2013) and Mirkin, et al., Small, 10:186-192.

Self-assembling nanoparticles with RNA may be constructed with polyethyleneimine (PEI) that is PEGylated with an Arg-Gly-Asp (RGD) peptide ligand attached at the distal end of the polyethylene glycol (PEG).

In general, a "nanoparticle" refers to any particle having a diameter of less than 1000 nm. In some cases, nanoparticles suitable for use in delivering a Class 2 CRISPR/Cas effector protein of the present disclosure, a Class 2 CRISPR/ Cas effector fusion polypeptide of the present disclosure, an RNP of the present disclosure, a nucleic acid of the present disclosure (e.g., a CRISPR/Cas guide RNA and/or a CRISPR/Cas trancRNA), or a Class 2 CRISPR/Cas system of the present disclosure, to a target cell have a diameter of 500 nm or less, e.g., from 25 nm to 35 nm, from 35 nm to 50 nm, from 50 nm to 75 mil, from 75 nm to 100 nm, from 100 nm to 150 mil, from 150 nm to 200 nm, from 200 mil to 300 nm, from 300 nm to 400 nm, or from 400 nm to 500 nm. In some cases, nanoparticles suitable for use in delivering a Class 2 CRISPR/Cas effector protein of the present disclosure, a Class 2 CRISPR/Cas effector fusion polypeptide of the present disclosure, an RNP of the present disclosure, a nucleic acid of the present disclosure, or a Class 2 CRISPR/Cas system of the present disclosure, to a target cell have a diameter of from 25 nm to 200 nm. In some cases, nanoparticles suitable for use in delivering a Class 2 CRISPR/Cas effector protein of the present disclosure, a Class 2 CRISPR/Cas effector fusion polypeptide of the present disclosure, an RNP of the present disclosure, a nucleic acid of the present disclosure, or a Class 2 CRISPR/ Cas system of the present disclosure, to a target cell have a diameter of 100 nm or less In some cases, nanoparticles suitable for use in delivering a Class 2 CRISPR/Cas effector protein of the present disclosure, a Class 2 CRISPR/Cas effector fusion polypeptide of the present disclosure, an RNP of the present disclosure, a nucleic acid of the present disclosure, or a Class 2 CRISPR/Cas system of the present disclosure, to a target cell have a diameter of from 35 nm to 60 nm.

Nanoparticles suitable for use in delivering a Class 2 CRISPR/Cas effector protein of the present disclosure, a Class 2 CRISPR/Cas effector fusion polypeptide of the present disclosure, an RNP of the present disclosure, a nucleic acid of the present disclosure (e.g., a CRISPR/Cas guide RNA and/or a CRISPR/Cas trancRNA), or a Class 2 CRISPR/Cas system of the present disclosure, to a target cell may be provided in different forms, e.g., as solid nanoparticles (e.g., metal such as silver, gold, iron, titanium), non-metal, lipid-based solids, polymers), suspensions of nanoparticles, or combinations thereof. Metal, dielectric, and semiconductor nanoparticles may be prepared, as well as hybrid structures (e.g., core-shell nanoparticles). Nanoparticles made of semiconducting material may also be labeled quantum dots if they are small enough (typically below 10 nm) that quantization of electronic energy levels occurs. Such nanoscale particles are used in biomedical applications as drug carriers or imaging agents and may be adapted for similar purposes in the present disclosure.

Semi-solid and soft nanoparticles are also suitable for use in delivering a Class 2 CRISPR/Cas effector protein of the present disclosure, a Class 2 CRISPR/Cas effector fusion polypeptide of the present disclosure, an RNP of the present disclosure, a nucleic acid of the present disclosure (e.g., a CRISPR/Cas guide RNA and/or a CRISPR/Cas trancRNA), or a Class 2 CRISPR/Cas system of the present disclosure, to a target cell. A prototype nanoparticle of semi-solid nature is the liposome.

In some cases, an exosome is used to deliver a Class 2 CRISPR/Cas effector protein of the present disclosure, a Class 2 CRISPR/Cas effector fusion polypeptide of the present disclosure, an RNP of the present disclosure, a nucleic acid of the present disclosure (e.g., a CRISPR/Cas guide RNA and/or a CRISPR/Cas trancRNA), or a Class 2 CRISPR/Cas system of the present disclosure, to a target cell. Exosomes are endogenous nano-vesicles that transport RNAs and proteins, and which can deliver RNA to the brain and other target organs.

In some cases, a liposome is used to deliver a Class 2 CRISPR/Cas effector protein of the present disclosure, a Class 2 CRISPR/Cas effector fusion polypeptide of the present disclosure, an RNP of the present disclosure, a nucleic acid of the present disclosure (e.g., a CRISPR/Cas guide RNA and/or a CRISPR/Cas trancRNA), or a Class 2 CRISPR/Cas system of the present disclosure, to a target cell. Liposomes are spherical vesicle structures composed of a uni- or multilamellar lipid bilayer surrounding internal aqueous compartments and a relatively impermeable outer lipophilic phospholipid bilayer. Liposomes can be made from several different types of lipids; however, phospholipids are most commonly used to generate liposomes. Although liposome formation is spontaneous when a lipid film is mixed with an aqueous solution, it can also be expedited by applying force in the form of shaking by using a homogenizer, sonicator, or an extrusion apparatus. Several other additives may be added to liposomes in order to modify their structure and properties. For instance, either cholesterol or sphingomyelin may be added to the liposomal mixture in order to help stabilize the liposomal structure and to prevent the leakage of the liposomal inner cargo. A liposome formulation may be mainly comprised of natural phospholipids and lipids such as 1,2-distearoryl-sn-glycero-3-phosphatidyl choline (DSPC), sphingomyelin, egg phosphatidylcholines and monosialoganglioside.

A stable nucleic-acid-lipid particle (SNALP) can be used to deliver a Class 2 CRISPR/Cas effector protein of the present disclosure, a Class 2 CRISPR/Cas effector fusion polypeptide of the present disclosure, an RNP of the present disclosure, a nucleic acid of the present disclosure (e.g., a CRISPR/Cas guide RNA and/or a CRISPR/Cas trancRNA), or a Class 2 CRISPR/Cas system of the present disclosure, to a target cell. The SNALP formulation may contain the lipids 3-N-[(methoxypoly(ethylene glycol) 2000) carbamoyl]-1,2-dimyristyloxy-propylamine (PEG-C-DMA), 1,2-dilinoleyloxy-N,N-dimethyl-3-aminopropane (DLinDMA), 1,2-distearoyl-sn-glycero-3-phosphocholine (DSPC) and cholesterol, in a 2:40:10:48 molar percent ratio. The SNALP liposomes may be prepared by formulating D-Lin-DMA and PEG-C-DMA with distearoylphosphatidylcholine (DSPC), Cholesterol and siRNA using a 25:1 lipid/siRNA ratio and a 48/40/10/2 molar ratio of Cholesterol/D-Lin-DMA/DSPC/PEG-C-DMA. The resulting SNALP liposomes can be about 80-100 nm in size. A SNALP may comprise synthetic cholesterol (Sigma-Aldrich, St Louis, Mo., USA), dipalmitoylphosphatidylcholine (Avanti Polar Lipids, Alabaster, Ala., USA), 3-N-[(w-methoxy poly(ethylene glycol)2000) carbamoyl]-1,2-dimyrestyloxypropylamine, and cationic 1,2-dilinoleyloxy-3-N,Ndimethylaminopropane. A SNALP may comprise synthetic cholesterol (Sigma-Aldrich), 1,2-distearoyl-sn-glycero-3-phosphocholine (DSPC; Avanti Polar Lipids Inc.), PEG-cDMA, and 1,2-dilinoleyloxy-3-(N;N-dimethyl)aminopropane (DLinDMA).

Other cationic lipids, such as amino lipid 2,2-dilinoleyl-4-dimethylaminoethyl-[1,3]-dioxolane (DLin-KC2-DMA) can be used to deliver a Class 2 CRISPR/Cas effector protein of the present disclosure, a Class 2 CRISPR/Cas effector fusion polypeptide of the present disclosure, an RNP of the present disclosure, a nucleic acid of the present disclosure (e.g., a CRISPR/Cas guide RNA and/or a CRISPR/Cas trancRNA), or a Class 2 CRISPR/Cas system of the present disclosure, to a target cell. A preformed vesicle with the following lipid composition may be contemplated: amino lipid, distearoylphosphatidylcholine (DSPC), cholesterol and (R)-2,3-bis(octadecyloxy) propyl-1-(methoxy poly(ethylene glycol)2000)propylcarbamate (PEG-lipid) in the molar ratio 40/10/40/10, respectively, and a FVII siRNA/total lipid ratio of approximately 0.05 (w/w). To ensure a narrow particle size distribution in the range of 70-90 nm and a low polydispersity index of 0.11.+−.0.04 (n=56), the particles may be extruded up to three times through 80 nm membranes prior to adding the guide RNA. Particles containing the highly potent amino lipid 16 may be used, in which the molar ratio of the four lipid components 16, DSPC, cholesterol and PEG-lipid (50/10/38.5/1.5) which may be further optimized to enhance in vivo activity.

Lipids may be formulated with a Class 2 CRISPR/Cas system of the present disclosure or component(s) thereof or nucleic acids encoding the same to form lipid nanoparticles (LNPs). Suitable lipids include, but are not limited to, DLin-KC2-DMA4, C12-200 and colipids disteroylphosphatidyl choline, cholesterol, and PEG-DMG may be formulated with a Class 2 CRISPR/Cas system, or component thereof, of the present disclosure, using a spontaneous vesicle formation procedure. The component molar ratio may be about 50/10/38.5/1.5 (DLin-KC2-DMA or C12-200/disteroylphosphatidyl choline/cholesterol/PEG-DMG).

A Class 2 CRISPR/Cas system of the present disclosure, or a component thereof, may be delivered encapsulated in PLGA microspheres such as that further described in US published applications 20130252281 and 20130245107 and 20130244279.

Supercharged proteins can be used to deliver a Class 2 CRISPR/Cas effector protein of the present disclosure, a Class 2 CRISPR/Cas effector fusion polypeptide of the present disclosure, an RNP of the present disclosure, a nucleic acid of the present disclosure (e.g., a CRISPR/Cas guide RNA and/or a CRISPR/Cas trancRNA), or a Class 2 CRISPR/Cas system of the present disclosure, to a target cell. Supercharged proteins are a class of engineered or naturally occurring proteins with unusually high positive or negative net theoretical charge. Both supernegatively and superpositively charged proteins exhibit the ability to withstand thermally or chemically induced aggregation. Superpositively charged proteins are also able to penetrate mammalian cells. Associating cargo with these proteins, such as plasmid DNA, RNA, or other proteins, can enable the functional delivery of these macromolecules into mammalian cells both in vitro and in vivo.

Cell Penetrating Peptides (CPPs) can be used to deliver a Class 2 CRISPR/Cas effector protein of the present disclosure, a Class 2 CRISPR/Cas effector fusion polypeptide of the present disclosure, an RNP of the present disclosure, a nucleic acid of the present disclosure (e.g., a CRISPR/Cas guide RNA and/or a CRISPR/Cas trancRNA), or a Class 2 CRISPR/Cas system of the present disclosure, to a target cell. CPPs typically have an amino acid composition that either contains a high relative abundance of positively charged amino acids such as lysine or arginine or has sequences that contain an alternating pattern of polar/charged amino acids and non-polar, hydrophobic amino acids.

An implantable device can be used to deliver a Class 2 CRISPR/Cas effector protein of the present disclosure, a Class 2 CRISPR/Cas effector fusion polypeptide of the present disclosure, an RNP of the present disclosure, a nucleic acid of the present disclosure (e.g., a CRISPR/Cas guide RNA and/or a CRISPR/Cas trancRNA) (e.g., a CRISPR/Cas guide RNA, a nucleic acid encoding a CRISPR/Cas guide RNA, a nucleic acid encoding Class 2 CRISPR/Cas effector protein, a donor template, and the like), or a Class 2 CRISPR/Cas system of the present disclosure, to a target cell (e.g., a target cell in vivo, where the target cell is a target cell in circulation, a target cell in a tissue, a target cell in an organ, etc.). An implantable device suitable for use in delivering a Class 2 CRISPR/Cas effector protein of the present disclosure, a Class 2 CRISPR/Cas effector fusion polypeptide of the present disclosure, an RNP of the present disclosure, a nucleic acid of the present disclosure (e.g., a CRTSPR/Cas guide RNA and/or a CRISPR/Cas trancRNA), or a Class 2 CRISPR/Cas system of the present disclosure, to a target cell (e.g., a target cell in vivo, where the target cell is a target cell in circulation, a target cell in a tissue, a target cell in an organ, etc.) can include a container (e.g., a reservoir, a matrix, etc.) that comprises the Class 2 CRISPR/Cas effector protein, the Class 2 CRISPR/Cas effector fusion polypeptide, the RNP, or the Class 2 CRISPR/Cas system (or component thereof, e.g., a nucleic acid of the present disclosure).

A suitable implantable device can comprise a polymeric substrate, such as a matrix for example, that is used as the device body, and in some cases additional scaffolding materials, such as metals or additional polymers, and materials to enhance visibility and imaging. An implantable delivery device can be advantageous in providing release locally and over a prolonged period, where the polypeptide and/or nucleic acid to be delivered is released directly to a target site, e.g., the extracellular matrix (ECM), the vasculature surrounding a tumor, a diseased tissue, etc. Suitable implantable delivery devices include devices suitable for use in delivering to a cavity such as the abdominal cavity and/or any other type of administration in which the drug delivery system is not anchored or attached, comprising a biostable and/or degradable and/or bioabsorbable polymeric substrate, which may for example optionally be a matrix. In some cases, a suitable implantable drug delivery device comprises degradable polymers, wherein the main release mechanism is bulk erosion. In some cases, a suitable implantable drug delivery device comprises non degradable, or slowly degraded polymers, wherein the main release mechanism is diffusion rather than bulk erosion, so that the outer part functions as membrane, and its internal part functions as a drug reservoir, which practically is not affected by the surroundings for an extended period (for example from about a week to about a few months). Combinations of different polymers with different release mechanisms may also optionally be used. The concentration gradient at the can be maintained effectively constant during a significant period of the total releasing period, and therefore the diffusion rate is effectively constant (termed "zero mode" diffusion). By the term "constant" it is meant a diffusion rate that is maintained above the lower threshold of therapeutic effectiveness, but which may still optionally feature an initial burst and/or may fluctuate, for example increasing and decreasing to a certain degree. The diffusion rate can be so maintained for a prolonged period, and it can be considered constant to a certain level to optimize the therapeutically effective period, for example the effective silencing period.

In some cases, the implantable delivery system is designed to shield the nucleotide based therapeutic agent from degradation, whether chemical in nature or due to attack from enzymes and other factors in the body of the subject.

The site for implantation of the device, or target site, can be selected for maximum therapeutic efficacy. For example, a delivery device can be implanted within or in the proximity of a tumor environment, or the blood supply associated with a tumor. The target location can be, e.g.: 1) the brain at degenerative sites like in Parkinson or Alzheimer disease at the basal ganglia, white and gray matter; 2) the spine, as in the case of amyotrophic lateral sclerosis (ALS); 3) uterine cervix; 4) active and chronic inflammatory joints; 5) dermis as in the case of psoriasis; 7) sympathetic and sensoric nervous sites for analgesic effect; 7) a bone; 8) a site of acute or chronic infection; 9) Intra vaginal; 10) Inner ear-auditory system, labyrinth of the inner ear, vestibular system; 11) Intra tracheal; 12) Intra-cardiac; coronary, epicardiac; 13) urinary tract or bladder; 14) biliary system; 15) parenchymal tissue including and not limited to the kidney, liver, spleen; 16) lymph nodes; 17) salivary glands; 18) dental gums; 19) Intra-articular (into joints); 20) Intra-ocular; 21) Brain tissue; 22) Brain ventricles; 23) Cavities, including abdominal cavity (for example but without limitation, for ovary cancer); 24) Intra esophageal; and 25) Intra rectal; and 26) into the vasculature.

The method of insertion, such as implantation, may optionally already be used for other types of tissue implantation and/or for insertions and/or for sampling tissues, optionally without modifications, or alternatively optionally only with non-major modifications in such methods. Such methods optionally include but are not limited to brachytherapy methods, biopsy, endoscopy with and/or without ultrasound, such as stereotactic methods into the brain tissue, laparoscopy, including implantation with a laparoscope into joints, abdominal organs, the bladder wall and body cavities.

Modified Host Cells

The present disclosure provides a modified cell comprising a Class 2 CRISPR/Cas effector protein of the present disclosure and/or a nucleic acid comprising a nucleotide sequence encoding a Class 2 CRISPR/Cas effector protein of the present disclosure. The present disclosure provides a modified cell comprising a Class 2 CRISPR/Cas effector protein of the present disclosure, where the modified cell is a cell that does not normally comprise a Class 2 CRISPR/Cas effector protein of the present disclosure. The present disclosure provides a modified cell (e.g., a genetically modified cell) comprising nucleic acid comprising a nucleotide sequence encoding a Class 2 CRISPR/Cas effector protein of the present disclosure. The present disclosure provides a genetically modified cell that is genetically modified with an mRNA comprising a nucleotide sequence encoding a Class 2 CRISPR/Cas effector protein of the present disclosure. The present disclosure provides a genetically modified cell that is genetically modified with a recombinant expression vector comprising a nucleotide sequence encoding a Class 2 CRISPR/Cas effector protein of the present disclosure. The present disclosure provides a genetically modified cell that is genetically modified with a recombinant expression vector comprising: a) a nucleotide sequence encoding a Class 2 CRISPR/Cas effector protein of the present disclosure; and b) a nucleotide sequence encoding a CRISPR/Cas guide RNA of the present disclosure. The present disclosure provides a genetically modified cell that is genetically modified with a recombinant expression vector comprising: a) a nucleotide sequence encoding a Class 2 CRISPR/Cas effector protein of the present disclosure; b) a nucleotide sequence encoding a CRISPR/Cas guide RNA of the present disclosure; and c) a nucleotide sequence encoding a donor template.

A cell that serves as a recipient for a Class 2 CRISPR/Cas effector protein of the present disclosure and/or a nucleic acid comprising a nucleotide sequence encoding a Class 2 CRISPR/Cas effector protein of the present disclosure and/or a CRISPR/Cas guide RNA of the present disclosure (or a nucleic acid encoding it) and/or a CRISPR/Cas trancRNA (or a nucleic acid encoding it), can be any of a variety of cells, including, e.g., in vitro cells; in vivo cells; ex vivo cells; primary cells; cancer cells; animal cells; plant cells; algal cells; fungal cells; etc. A cell that serves as a recipient for a Class 2 CRISPR/Cas effector protein of the present disclosure and/or a nucleic acid comprising a nucleotide sequence encoding a Class 2 CRISPR/Cas effector protein of the present disclosure and/or a CRISPR/Cas guide RNA of the present disclosure is referred to as a "host cell" or a "target cell." A host cell or a target cell can be a recipient of a Class 2 CRISPR/Cas system of the present disclosure. A host cell or a target cell can be a recipient of a CRISPR/Cas RNP. A host cell or a target cell can be a recipient of a single component of a Class 2 CRISPR/Cas system of the present disclosure.

Non-limiting examples of cells (target cells) include: a prokaryotic cell, eukaryotic cell, a bacterial cell, an archaeal cell, a cell of a single-cell eukaryotic organism, a protozoa cell, a cell from a plant (e.g., cells from plant crops, fruits, vegetables, grains, soy bean, corn, maize, wheat, seeds, tomatoes, rice, cassava, sugarcane, pumpkin, hay, potatoes, cotton, *cannabis*, tobacco, flowering plants, conifers, gymnosperms, angiosperms, ferns, clubmosses, hornworts, liverworts, mosses, dicotyledons, monocotyledons, etc.), an algal cell, (e.g., *Botryococcus braunii, Chlamydomonas reinhardtii, Nannochloropsis gaditana, Chlorella pyrenoidosa, Sargassum patens, C. agardh*, and the like), seaweeds (e.g. kelp) a fungal cell (e.g., a yeast cell, a cell from a mushroom), an animal cell, a cell from an invertebrate animal (e.g., fruit fly, cnidarian, echinoderm, nematode, etc.), a cell from a vertebrate animal (e.g., fish, amphibian, reptile, bird, mammal), a cell from a mammal (e.g., an ungulate (e.g., a pig, a cow, a goat, a sheep); a rodent (e.g., a rat, a mouse); a non-human primate; a human; a feline (e.g., a cat); a canine (e.g., a dog); etc.), and the like. In some cases, the cell is a cell that does not originate from a natural organism (e.g., the cell can be a synthetically made cell; also referred to as an artificial cell).

A cell can be an in vitro cell (e.g., a cell in culture, e.g., an established cultured cell line). A cell can be an ex vivo cell (cultured cell from an individual). A cell can be and in vivo cell (e.g., a cell in an individual). A cell can be an isolated cell. A cell can be a cell inside of an organism. A cell can be an organism. A cell can be a cell in a cell culture (e.g., in vitro cell culture). A cell can be one of a collection of cells. A cell can be a prokaryotic cell or derived from a prokaryotic cell. A cell can be a bacterial cell or can be derived from a bacterial cell. A cell can be an archaeal cell or derived from an archaeal cell. A cell can be a eukaryotic cell or derived from a eukaryotic cell. A cell can be a plant cell or derived from a plant cell. A cell can be an animal cell or derived from an animal cell. A cell can be an invertebrate cell or derived from an invertebrate cell. A cell can be a vertebrate cell or derived from a vertebrate cell. A cell can be a mammalian cell or derived from a mammalian cell. A cell can be a rodent cell or derived from a rodent cell. A cell can be a human cell or derived from a human cell. A cell can be a microbe cell or derived from a microbe cell. A cell can be a fungi cell or derived from a fungi cell. A cell can be an insect cell. A cell can be an arthropod cell. A cell can be a protozoan cell. A cell can be a helminth cell.

Suitable cells include a stem cell (e.g. an embryonic stem (ES) cell, an induced pluripotent stem (iPS) cell; a germ cell (e.g., an oocyte, a sperm, an oogonia, a spermatogonia, etc.); a somatic cell, e.g. a fibroblast, an oligodendrocyte, a glial cell, a hematopoietic cell, a neuron, a muscle cell, a bone cell, a hepatocyte, a pancreatic cell, etc.

Suitable cells include human embryonic stem cells, fetal cardiomyocytes, myofibroblasts, mesenchymal stem cells, autotransplated expanded cardiomyocytes, adipocytes, totipotent cells, pluripotent cells, blood stem cells, myoblasts, adult stem cells, bone marrow cells, mesenchymal cells, embryonic stem cells, parenchymal cells, epithelial cells, endothelial cells, mesothelial cells, fibroblasts, osteoblasts, chondrocytes, exogenous cells, endogenous cells, stem cells, hematopoietic stem cells, bone-marrow derived progenitor cells, myocardial cells, skeletal cells, fetal cells, undifferentiated cells, multi-potent progenitor cells, unipotent progenitor cells, monocytes, cardiac myoblasts, skeletal myoblasts, macrophages, capillary endothelial cells, xenogenic cells, allogenic cells, and post-natal stem cells.

In some cases, the cell is an immune cell, a neuron, an epithelial cell, and endothelial cell, or a stem cell. In some cases, the immune cell is a T cell, a B cell, a monocyte, a natural killer cell, a dendritic cell, or a macrophage. In some cases, the immune cell is a cytotoxic T cell. In some cases, the immune cell is a helper T cell. In some cases, the immune cell is a regulatory T cell (Treg).

In some cases, the cell is a stem cell. Stem cells include adult stem cells. Adult stem cells are also referred to as somatic stem cells.

Adult stem cells are resident in differentiated tissue, but retain the properties of self-renewal and ability to give rise to multiple cell types, usually cell types typical of the tissue in which the stem cells are found. Numerous examples of somatic stem cells are known to those of skill in the art, including muscle stem cells; hematopoietic stem cells; epithelial stem cells; neural stem cells; mesenchymal stem cells; mammary stem cells; intestinal stem cells; mesodermal stem cells; endothelial stem cells; olfactory stem cells; neural crest stem cells; and the like.

Stem cells of interest include mammalian stem cells, where the term "mammalian" refers to any animal classified as a mammal, including humans; non-human primates; domestic and farm animals; and zoo, laboratory, sports, or pet animals, such as dogs, horses, cats, cows, mice, rats, rabbits, etc. In some cases, the stem cell is a human stem cell. In some cases, the stem cell is a rodent (e.g., a mouse; a rat) stem cell. In some cases, the stem cell is a non-human primate stem cell.

Stem cells can express one or more stem cell markers, e.g., SOX9, KRT19, KRT7, LGR5, CA9, FXYD2, CDH6, CLDN18, TSPAN8, BPIFB1, OLFM4, CDH17, and PPARGC1A.

In some embodiments, the stem cell is a hematopoietic stem cell (HSC). HSCs are mesoderm-derived cells that can be isolated from bone marrow, blood, cord blood, fetal liver and yolk sac. HSCs are characterized as $CD34^+$ and $CD3^-$. HSCs can repopulate the erythroid, neutrophil-macrophage, megakaryocyte and lymphoid hematopoietic cell lineages in vivo. In vitro, HSCs can be induced to undergo at least some self-renewing cell divisions and can be induced to differentiate to the same lineages as is seen in vivo. As such, HSCs can be induced to differentiate into one or more of erythroid cells, megakaryocytes, neutrophils, macrophages, and lymphoid cells.

In other embodiments, the stem cell is a neural stem cell (NSC). Neural stem cells (NSCs) are capable of differentiating into neurons, and glia (including oligodendrocytes, and astrocytes). A neural stem cell is a multipotent stem cell which is capable of multiple divisions, and under specific conditions can produce daughter cells which are neural stem cells, or neural progenitor cells that can be neuroblasts or glioblasts, e.g., cells committed to become one or more types of neurons and glial cells respectively. Methods of obtaining NSCs are known in the art.

In other embodiments, the stem cell is a mesenchymal stem cell (MSC). MSCs originally derived from the embryonal mesoderm and isolated from adult bone marrow, can differentiate to form muscle, bone, cartilage, fat, marrow stroma, and tendon. Methods of isolating MSC are known in the art; and any known method can be used to obtain MSC. See, e.g., U.S. Pat. No. 5,736,396, which describes isolation of human MSC.

A cell is in some cases a plant cell. A plant cell can be a cell of a monocotyledon. A cell can be a cell of a dicotyledon.

In some cases, the cell is a plant cell. For example, the cell can be a cell of a major agricultural plant, e.g., Barley, Beans (Dry Edible), Canola, Corn, Cotton (Pima), Cotton (Upland), Flaxseed, Hay (Alfalfa), Hay (Non-Alfalfa), Oats, Peanuts, Rice, Sorghum, Soybeans, Sugarbeets, Sugarcane, Sunflowers (Oil), Sunflowers (Non-Oil), Sweet Potatoes, Tobacco (Burley), Tobacco (Flue-cured), Tomatoes, Wheat (Durum), Wheat (Spring), Wheat (Winter), and the like. As another example, the cell is a cell of a vegetable crops which include but are not limited to, e.g., alfalfa sprouts, aloe leaves, arrow root, arrowhead, artichokes, asparagus, bamboo shoots, banana flowers, bean sprouts, beans, beet tops, beets, bittermelon, bok choy, broccoli, broccoli rabe (rappini), brussels sprouts, cabbage, cabbage sprouts, cactus leaf (nopales), calabaza, cardoon, carrots, cauliflower, celery, chayote, chinese artichoke (crosnes), chinese cabbage, chinese celery, chinese chives, choy sum, *chrysanthemum* leaves (tung ho), collard greens, corn stalks, corn-sweet, cucumbers, daikon, dandelion greens, dasheen, dau mue (pea tips), donqua (winter melon), eggplant, endive, escarole, fiddle head ferns, field cress, frisee, gai choy (chinese mustard), gallon, galanga (siam, thai ginger), garlic, ginger root, gobo, greens, hanover salad greens, huauzontle, jerusalem artichokes, jicama, kale greens, kohlrabi, lamb's quarters (quilete), lettuce (bibb), lettuce (boston), lettuce (boston red), lettuce (green leaf), lettuce (iceberg), lettuce (lolla rossa), lettuce (oak leaf—green), lettuce (oak leaf—red), lettuce (processed), lettuce (red leaf), lettuce (romaine), lettuce (ruby romaine), lettuce (russian red mustard), linkok, lo bok, long beans, lotus root, mache, maguey (agave) leaves, malanga, mesculin mix, mizuna, moap (smooth luffa), moo, moqua (fuzzy squash), mushrooms, mustard, nagaimo, okra, ong choy, onions green, opo (long squash), ornamental corn, ornamental gourds, parsley, parsnips, peas, peppers (bell type), peppers, pumpkins, radicchio, radish sprouts, radishes, rape greens, rape greens, rhubarb, romaine (baby red), rutabagas, salicornia (sea bean), sinqua (angled/ridged luffa), spinach, squash, straw bales, sugarcane, sweet potatoes, swiss chard, tamarindo, taro, taro leaf, taro shoots, tatsoi, tepeguaje (guaje), tindora, tomatillos, tomatoes, tomatoes (cherry), tomatoes (grape type), tomatoes (plum type), tumeric, turnip tops greens, turnips, water chestnuts, yampi, yams (names), yu choy, yuca (cassava), and the like.

A cell is in some cases an arthropod cell. For example, the cell can be a cell of a sub-order, a family, a sub-family, a group, a sub-group, or a species of, e.g., Chelicerata, Myriapodia, Hexipodia, Arachnida, Insecta, Archaeognatha, Thysanura, Palaeoptera, Ephemeroptera, Odonata, Anisoptera, Zygoptera, Neoptera, Exopterygota, Plecoptera, Embioptera, Orthoptera, Zoraptera, Dermaptera, Dictyoptera, Notoptera, Grylloblattidae, Mantophasmatidae, Phasmatodea, Blattaria, Isoptera, Mantodea, Parapneuroptera, Psocoptera, Thysanoptera, Phthiraptera, Hemiptera, Endopterygota or Holometabola, Hymenoptera, Coleoptera, Strepsiptera, Raphidioptera, Megaloptera, Neuroptera, Mecoptera, Siphonaptera, Diptera, Trichoptera, or Lepidoptera.

A cell is in some cases an insect cell. For example, in some cases, the cell is a cell of a mosquito, a grasshopper, a true bug, a fly, a flea, a bee, a wasp, an ant, a louse, a moth, or a beetle.

Kits

The present disclosure provides a kit comprising a Class 2 CRISPR/Cas system of the present disclosure, or a component of a Class 2 CRISPR/Cas system of the present disclosure.

A kit of the present disclosure can comprise any combination as listed for a Class 2 CRISPR/Cas system (e.g., see above). A kit of the present disclosure can comprise: a) a component, as described above, of a Class 2 CRISPR/Cas system of the present disclosure, or can comprise a Class 2 CRISPR/Cas system of the present disclosure; and b) one or more additional reagents, e.g., i) a buffer; ii) a protease inhibitor; iii) a nuclease inhibitor; iv) a reagent required to develop or visualize a detectable label; v) a positive and/or negative control target DNA; vi) a positive and/or negative control CRISPR/Cas guide RNA; vii) a CRISPR/Cas trancRNA; and the like. A kit of the present disclosure can comprise: a) a component, as described above, of a Class 2 CRISPR/Cas system of the present disclosure, or can comprise a Class 2 CRISPR/Cas system of the present disclosure; and b) a therapeutic agent.

A kit of the present disclosure can comprise a recombinant expression vector comprising: a) an insertion site for inserting a nucleic acid comprising a nucleotide sequence encoding a portion of a CRISPR/Cas guide RNA that hybridizes to a target nucleotide sequence in a target nucleic acid; and b) a nucleotide sequence encoding the protein-binding portion of a CRISPR/Cas guide RNA. A kit of the present disclosure can comprise a recombinant expression vector comprising: a) an insertion site for inserting a nucleic acid comprising a nucleotide sequence encoding a portion of a CRISPR/Cas guide RNA that hybridizes to a target nucleotide sequence in a target nucleic acid; b) a nucleotide sequence encoding the protein-binding portion of a CRISPR/Cas guide RNA; and c) a nucleotide sequence encoding a Class 2 CRISPR/Cas effector protein of the present disclosure. A kit of the present disclosure can comprise a recombinant expression vector comprising a nucleotide sequence encoding a CRISPR/Cas trancRNA.

Utility

Class 2 CRISPR/Cas compositions (e.g., expression vectors, kits, compositions, nucleic acids, and the like) find use in a variety of methods. For example, a Class 2 CRISPR/Cas composition of the present disclosure can be used to (i) modify (e.g., cleave, e.g., nick; methylate; etc.) target nucleic acid (DNA or RNA; single stranded or double stranded); (ii) modulate transcription of a target nucleic acid; (iii) label a target nucleic acid; (iv) bind a target nucleic acid (e.g., for purposes of isolation, labeling, imaging, tracking, etc.); (v) modify a polypeptide (e.g., a histone) associated with a target nucleic acid; and the like. Thus, the present disclosure provides a method of modifying a target nucleic acid. In some cases, a method of the present disclosure for modifying a target nucleic acid comprises contacting the target nucleic acid with: a) a Class 2 CRISPR/Cas effector protein of the present disclosure; and b) one or more (e.g., two) CRISPR/Cas guide RNAs. In some cases, a method of the present disclosure for modifying a target nucleic acid comprises contacting the target nucleic acid with: a) a Class 2 CRISPR/Cas effector protein, and b) one or more (e.g., two) CRISPR/Cas guide RNAs, and c) a CRISPR/Cas trancRNA. In some cases, a method of the present disclosure for modifying a target nucleic acid comprises contacting the target nucleic acid with: a) a Class 2 CRISPR/Cas effector protein of the present disclosure; b) a CRISPR/Cas guide RNA; and c) a donor nucleic acid (e.g, a donor template). In some cases, a method of the present disclosure for modifying a target nucleic acid comprises contacting the target nucleic acid with: a) a Class 2 CRISPR/Cas effector protein; b) a CRISPR/Cas guide RNA; c) a CRISPR/Cas trancRNA, and d) a donor nucleic acid (e.g, a donor template). In some cases, the contacting step is carried out in a cell in vitro. In some cases, the contacting step is carried out in a cell in vivo. In some cases, the contacting step is carried out in a cell ex vivo.

Because a method that uses a Class 2 CRISPR/Cas effector protein includes binding of the Class 2 CRISPR/Cas effector protein to a particular region in a target nucleic acid (by virtue of being targeted there by an associated CRISPR/

Cas guide RNA), the methods are generally referred to herein as methods of binding (e.g., a method of binding a target nucleic acid). However, it is to be understood that in some cases, while a method of binding may result in nothing more than binding of the target nucleic acid, in other cases, the method can have different final results (e.g., the method can result in modification of the target nucleic acid, e.g., cleavage/methylation/etc., modulation of transcription from the target nucleic acid; modulation of translation of the target nucleic acid; genome editing; modulation of a protein associated with the target nucleic acid; isolation of the target nucleic acid; etc.).

For examples of suitable methods (e.g., that are used with CRISPR/Cas9 systems), see, for example, Jinek et al., Science. 2012 Aug. 17; 337(6096):816-21; Chylinski et al., RNA Biol. 2013 May; 10(5):726-37; Ma et at, Biomed Res Int. 2013; 2013:270805; Hou et al., Proc Natl Acad Sci USA. 2013 Sep. 24; 110(39):15644-9; Jinek et al., Elife. 2013; 2:e00471; Pattanayak et al., Nat Biotechnol. 2013 September; 31(9):839-43; Qi et al, Cell. 2013 Feb. 28; 152(5):1173-83; Wang et al., Cell. 2013 May 9; 153(4):910-8; Auer et al., Genome Res. 2013 Oct. 31; Chen et al., Nucleic Acids Res. 2013 Nov. 1; 41(20):e19; Cheng et al., Cell Res. 2013 October; 23(10):1163-71; Cho et al., Genetics. 2013 November; 195(3):1177-80; DiCarlo et al., Nucleic Acids Res. 2013 April; 41(7):4336-43; Dickinson et al., Nat Methods. 2013 October; 10(10):1028-34; Ebina et al., Sci Rep. 2013; 3:2510; Fujii et al, Nucleic Acids Res. 2013 Nov. 1; 41(20):e187; Hu et al., Cell Res. 2013 November; 23(11): 1322-5; Jiang et al., Nucleic Acids Res. 2013 Nov. 1; 41(20):e188; Larson et al., Nat Protoc. 2013 November; 8(11):2180-96; *Mali* et. at., Nat Methods. 2013 October; 10(10):957-63; Nakayama et al., Genesis. 2013 December; 51(12):835-43; Ran et al., Nat Protoc. 2013 November; 8(11):2281-308; Ran et al., Cell. 2013 Sep. 12; 154(6):1380-9; Upadhyay et al., G3 (Bethesda). 2013 Dec. 9; 3(12):2233-8; Walsh et al., Proc Natl Acad Sci USA. 2013 Sep. 24; 110(39):15514-5; Xie et al., Mol Plant. 2013 Oct. 9; Yang et al., Cell. 2013 Sep. 12; 154(6):1370-9; and U.S. patents and patent applications: U.S. Pat. Nos. 8,906,616; 8,895,308; 8,889,418; 8,889,356; 8,871,445; 8,865,406; 8,795,965; 8,771,945; 8,697,359; 20140068797; 20140170753; 20140179006; 20140179770; 20140186843; 20140186919; 20140186958; 20140189896; 20140227787; 20140234972; 20140242664; 20140242699; 20140242700; 20140242702; 20140248702; 20140256046; 20140273037; 20140273226; 20140273230; 20140273231; 20140273232; 20140273233; 20140273234; 20140273235; 20140287938; 20140295556; 20140295557; 20140298547; 20140304853; 20140309487; 20140310828; 20140310830; 20140315985; 20140335063; 20140335620; 20140342456; 20140342457; 20140342458; 20140349400; 20140349405; 20140356867; 20140356956; 20140356958; 20140356959; 20140357523; 20140357530; 20140364333; and 20140377868; each of which is hereby incorporated by reference in its entirety.

For example, the present disclosure provides (but is not limited to) methods of cleaving a target nucleic acid; methods of editing a target nucleic acid; methods of modulating transcription from a target nucleic acid; methods of isolating a target nucleic acid, methods of binding a target nucleic acid, methods of imaging a target nucleic acid, methods of modifying a target nucleic acid, and the like.

As used herein, the terms/phrases "contact a target nucleic acid" and "contacting a target nucleic acid", for example, with a Class 2 CRISPR/Cas effector protein or with a Class 2 CRISPR/Cas effector fusion polypeptide, etc., encompass all methods for contacting the target nucleic acid. For example, a Class 2 CRISPR/Cas effector protein can be provided to a cell as protein, RNA (encoding the Class 2 CRISPR/Cas effector protein), or DNA (encoding the Class 2 CRISPR/Cas effector protein); while a CRISPR/Cas guide RNA can be provided as a guide RNA or as a nucleic acid encoding the guide RNA and a CRISPR/Cas trancRNA can be provided as a trancRNA or as a nucleic acid encoding the trancRNA. As such, when, for example, performing a method in a cell (e.g., inside of a cell in vitro, inside of a cell in vivo, inside of a cell ex vivo), a method that includes contacting the target nucleic acid encompasses the introduction into the cell of any or all of the components in their active/final state (e.g., in the form of a protein(s) for Class 2 CRISPR/Cas effector protein; in the form of a protein for a Class 2 CRISPR/Cas effector fusion polypeptide; in the form of an RNA in some cases for the guide RNA), and also encompasses the introduction into the cell of one or more nucleic acids encoding one or more of the components (e.g., nucleic acid(s) comprising nucleotide sequence(s) encoding a Class 2 CRISPR/Cas effector protein or a Class 2 CRISPR/Cas effector fusion polypeptide, nucleic acid(s) comprising nucleotide sequence(s) encoding guide RNA(s), nucleic acid comprising a nucleotide sequence encoding a donor template, and the like). Because the methods can also be performed in vitro outside of a cell, a method that includes contacting a target nucleic acid, (unless otherwise specified) encompasses contacting outside of a cell in vitro, inside of a cell in vitro, inside of a cell in vivo, inside of a cell ex vivo, etc.

In some cases, a method of the present disclosure for modifying a target nucleic acid comprises introducing into a target cell a Class 2 CRISPR/Cas locus, e.g., a nucleic acid comprising a nucleotide sequence encoding a Class 2 CRISPR/Cas effector protein as well as nucleotide sequences of about 1 kilobase (kb) to 5 kb in length surrounding the Class 2 CRISPR/Cas effector protein-encoding nucleotide sequence from a cell (e.g., in some cases a cell that in its natural state (the state in which it occurs in nature) comprises a Cas12c locus) comprising a Cas12c locus, where the target cell does not normally (in its natural state) comprise a CRISPR/Cas locus (e.g., in some cases the locus includes a CRISPR/Cas trancRNA. However, one or more spacer sequences, encoding guide sequences for the encoded crRNA(s), can be modified such that one or more target sequences of interest are targeted. Thus, for example, in some cases, a method of the present disclosure for modifying a target nucleic acid comprises introducing into a target cell a CRISPR/Cas locus, e.g., a nucleic acid obtained from a source cell (e.g., in some cases a cell that in its natural state (the state in which it occurs in nature) comprises a CRTSPR/Cas locus), where the nucleic acid has a length of from 100 nucleotides (nt) to 5 kb in length (e.g., from 100 nt to 500 nt, from 500 nt to 1 kb, from 1 kb to 1.5 kb, from 1.5 kb to 2 kb, from 2 kb to 2.5 kb, from 2.5 kb to 3 kb, from 3 kb to 3.5 kb, from 3.5 kb to 4 kb, or from 4 kb to 5 kb in length) and comprises a nucleotide sequence encoding a Class 2 CRISPR/Cas effector protein. As noted above, in some such cases, one or more spacer sequences, encoding guide sequences for the encoded crRNA(s), can be modified such that one or more target sequences of interest are targeted. In some cases, the method comprises introducing into a target cell: i) a CRISPR/Cas locus; and ii) a donor DNA template. In some cases, the target nucleic acid is in a cell-free composition in vitro. In some cases, the target nucleic acid is present in a target cell. In some cases, the target nucleic acid is present in a target cell, where the target cell is a prokaryotic cell. In some cases, the target nucleic acid is present in a target cell, where the target cell is a eukaryotic cell. In some cases, the target nucleic acid is present in a target cell, where the target cell is a mammalian cell. In some cases, the target nucleic acid is present in a target cell, where the target cell is a plant cell.

In some cases, a method of the present disclosure for modifying a target nucleic acid comprises contacting a target nucleic acid with a Class 2 CRISPR/Cas effector protein of the present disclosure, or with a Class 2 CRISPR/Cas effector fusion polypeptide of the present disclosure. In some cases, a method of the present disclosure for modifying a target nucleic acid comprises contacting a target nucleic acid with a Class 2 CRISPR/Cas effector protein and a CRISPR/Cas guide RNA. In some cases, a method of the present disclosure for modifying a target nucleic acid comprises contacting a target nucleic acid with a Class 2 CRISPR/Cas effector protein, a CRISPR/Cas guide RNA, and a CRISPR/Cas trancRNA. In some cases, a method of the present disclosure for modifying a target nucleic acid comprises contacting a target nucleic acid with a Class 2 CRISPR/Cas effector protein, a first CRISPR/Cas guide RNA, and a second CRISPR/Cas guide RNA (and in some cases a CRISPR/Cas trancRNA). In some cases, a method of the present disclosure for modifying a target nucleic acid comprises contacting a target nucleic acid with a Class 2 CRISPR/Cas effector protein of the present disclosure and a CRISPR/Cas guide RNA and a donor DNA template. In some cases, a method of the present disclosure for modifying a target nucleic acid comprises contacting a target nucleic acid with a Class 2 CRISPR/Cas effector protein of the present disclosure and a CRISPR/Cas guide RNA and a CRISPR/Cas trancRNA and a donor DNA template.

In some cases, the target nucleic acid is in a cell-free composition in vitro. In some cases, the target nucleic acid is present in a target cell. In some cases, the target nucleic acid is present in a target cell, where the target cell is a prokaryotic cell. In some cases, the target nucleic acid is present in a target cell, where the target cell is a eukaryotic cell. In some cases, the target nucleic acid is present in a target cell, where the target cell is a mammalian cell. In some cases, the target nucleic acid is present in a target cell, where the target cell is a plant cell.

Target Nucleic Acids and Target Cells of Interest

A target nucleic acid can be any nucleic acid (e.g., DNA, RNA), can be double stranded or single stranded, can be any type of nucleic acid (e.g., a chromosome (genomic DNA), derived from a chromosome, chromosomal DNA, plasmid, viral, extracellular, intracellular, mitochondrial, chloroplast, linear, circular, etc.) and can be from any organism (e.g., as long as the CRISPR/Cas guide RNA comprises a nucleotide sequence that hybridizes to a target sequence in a target nucleic acid, such that the target nucleic acid can be targeted).

A target nucleic acid can be DNA or RNA. A target nucleic acid can be double stranded (e.g., dsDNA, dsRNA) or single stranded (e.g., ssRNA, ssDNA). In some cases, a target nucleic acid is single stranded. In some cases, a target nucleic acid is a single stranded RNA (ssRNA). In some cases, a target ssRNA (e.g., a target cell ssRNA, a viral ssRNA, etc.) is selected from: mRNA, rRNA, tRNA, non-coding RNA (ncRNA), long non-coding RNA (lncRNA), and microRNA (miRNA). In some cases, a target nucleic acid is a single stranded DNA (ssDNA) (e.g., a viral DNA). As noted above, in some cases, a target nucleic acid is single stranded.

A target nucleic acid can be located anywhere, for example, outside of a cell in vitro, inside of a cell in vitro, inside of a cell in vivo, inside of a cell ex vivo. Suitable target cells (which can comprise target nucleic acids such as genomic DNA) include, but are not limited to: a bacterial cell; an archaeal cell; a cell of a single-cell eukaryotic organism; a plant cell; an algal cell, e.g., *Botryococcus braunii, Chlamydomonas reinhardtii, Nannochloropsis gaditana, Chlorella pyrenoidosa, Sargassum patens, C. agardh*, and the like; a fungal cell (e.g., a yeast cell); an animal cell; a cell from an invertebrate animal (e.g. fruit fly, a cnidarian, an echinoderm, a nematode, etc.); a cell of an insect (e.g., a mosquito; a bee; an agricultural pest; etc.); a cell of an arachnid (e.g., a spider; a tick; etc.); a cell from a vertebrate animal (e.g., a fish, an amphibian, a reptile, a bird, a mammal); a cell from a mammal (e.g., a cell from a rodent; a cell from a human; a cell of a non-human mammal; a cell of a rodent (e.g., a mouse, a rat); a cell of a lagomorph (e.g., a rabbit); a cell of an ungulate (e.g., a cow, a horse, a camel, a llama, a vicuna, a sheep, a goat, etc.); a cell of a marine mammal (e.g., a whale, a seal, an elephant seal, a dolphin, a sea lion; etc.) and the like. Any type of cell may be of interest (e.g. a stem cell, e.g. an embryonic stem (ES) cell, an induced pluripotent stem (iPS) cell, a germ cell (e.g., an oocyte, a sperm, an oogonia, a spermatogonia, etc.), an adult stem cell, a somatic cell, e.g. a fibroblast, a hematopoietic cell, a neuron, a muscle cell, a bone cell, a hepatocyte, a pancreatic cell; an in vitro or in vivo embryonic cell of an embryo at any stage, e.g., a 1-cell, 2-cell, 4-cell, 8-cell, etc. stage zebrafish embryo; etc.).

Cells may be from established cell lines or they may be primary cells, where "primary cells", "primary cell lines", and "primary cultures" are used interchangeably herein to refer to cells and cells cultures that have been derived from a subject and allowed to grow in vitro for a limited number of passages, i.e. splittings, of the culture. For example, primary cultures are cultures that may have been passaged 0 times, 1 time, 2 times, 4 times, 5 times, 10 times, or 15 times, but not enough times go through the crisis stage. Typically, the primary cell lines are maintained for fewer than 10 passages in vitro. Target cells can be unicellular organisms and/or can be grown in culture. If the cells are primary cells, they may be harvest from an individual by any convenient method. For example, leukocytes may be conveniently harvested by apheresis, leukocytapheresis, density gradient separation, etc., while cells from tissues such as skin, muscle, bone marrow, spleen, liver, pancreas, lung, intestine, stomach, etc. can be conveniently harvested by biopsy.

In some of the above applications, the subject methods may be employed to induce target nucleic acid cleavage, target nucleic acid modification, and/or to bind target nucleic acids (e.g., for visualization, for collecting and/or analyzing, etc.) in mitotic or post-mitotic cells in vivo and/or ex vivo and/or in vitro (e.g., to disrupt production of a protein encoded by a targeted mRNA, to cleave or otherwise modify target DNA, to geneically modify a target cell, and the like). Because the guide RNA provides specificity by hybridizing to target nucleic acid, a mitotic and/or post-mitotic cell of interest in the disclosed methods may include a cell from any organism (e.g. a bacterial cell, an archaeal cell, a cell of a single-cell eukaryotic organism, a plant cell, an algal cell, e.g., *Botryococcus braunii, Chlamydomonas reinhardtii, Nannochloropsis gaditana, Chlorella pyrenoidosa, Sargassum patens, C. agardh*, and the like, a fungal cell (e.g., a yeast cell), an animal cell, a cell from an invertebrate animal (e.g. fruit fly, cnidarian, echinoderm, nematode, etc.), a cell from a vertebrate animal (e.g., fish, amphibian, reptile, bird, mammal), a cell from a mammal, a cell from a rodent, a cell from a human, etc.). In some cases, a subject Class 2

CRISPR/Cas effector protein (and/or nucleic acid encoding the protein such as DNA and/or RNA), and/or CRISPR/Cas guide RNA (and/or a DNA encoding the guide RNA), and/or donor template, and/or RNP can be introduced into an individual (i.e., the target cell can be in vivo) (e.g., a mammal, a rat, a mouse, a pig, a primate, a non-human primate, a human, etc.). In some case, such an administration can be for the purpose of treating and/or preventing a disease, e.g., by editing the genome of targeted cells.

Plant cells include cells of a monocotyledon, and cells of a dicotyledon. The cells can be root cells, leaf cells, cells of the xylem, cells of the phloem, cells of the cambium, apical meristem cells, parenchyma cells, collenchyma cells, sclerenchyma cells, and the like. Plant cells include cells of agricultural crops such as wheat, corn, rice, sorghum, millet, soybean, etc. Plant cells include cells of agricultural fruit and nut plants, e.g., plant that produce apricots, oranges, lemons, apples, plums, pears, almonds, etc.

Additional examples of target cells are listed above in the section titled "Modified cells." Non-limiting examples of cells (target cells) include: a prokaryotic cell, eukaryotic cell, a bacterial cell, an archaeal cell, a cell of a single-cell eukaryotic organism, a protozoa cell, a cell from a plant (e.g., cells from plant crops, fruits, vegetables, grains, soy bean, corn, maize, wheat, seeds, tomatoes, rice, cassava, sugarcane, pumpkin, hay, potatos, cotton, *cannabis*, tobacco, flowering plants, conifers, gymnosperms, angiosperms, ferns, clubmosses, hornworts, liverworts, mosses, dicotyledons, monocotyledons, etc.), an algal cell, (e.g., *Botryococcus braunii, Chlarnydornonas reinhardtii, Nannochloropsis gaditana, Chlorella pyrenoidosa, Sargassum patens, C. agardh*, and the like), seaweeds (e.g. kelp) a fungal cell (e.g., a yeast cell, a cell from a mushroom), an animal cell, a cell from an invertebrate animal (e.g., fruit fly, cnidarian, echinoderm, nematode, etc.), a cell from a vertebrate animal (e.g., fish, amphibian, reptile, bird, mammal), a cell from a mammal (e.g., an ungulate (e.g., a pig, a cow, a goat, a sheep); a rodent (e.g., a rat, a mouse); a non-human primate; a human; a feline (e.g., a cat); a canine (e.g., a dog); etc.), and the like. In some cases, the cell is a cell that does not originate from a natural organism (e.g., the cell can be a synthetically made cell; also referred to as an artificial cell).

A cell can be an in vitro cell (e.g., established cultured cell line). A cell can be an ex vivo cell (cultured cell from an individual). A cell can be and in vivo cell (e.g., a cell in an individual). A cell can be an isolated cell. A cell can be a cell inside of an organism. A cell can be an organism. A cell can be a cell in a cell culture (e.g., in vitro cell culture). A cell can be one of a collection of cells. A cell can be a prokaryotic cell or derived from a prokaryotic cell. A cell can be a bacterial cell or can be derived from a bacterial cell. A cell can be an archaeal cell or derived from an archaeal cell. A cell can be a eukaryotic cell or derived from a eukaryotic cell. A cell can be a plant cell or derived from a plant cell. A cell can be an animal cell or derived from an animal cell. A cell can be an invertebrate cell or derived from an invertebrate cell. A cell can be a vertebrate cell or derived from a vertebrate cell. A cell can be a mammalian cell or derived from a mammalian cell. A cell can be a rodent cell or derived from a rodent cell. A cell can be a human cell or derived from a human cell. A cell can be a microbe cell or derived from a microbe cell. A cell can be a fungi cell or derived from a fungi cell. A cell can be an insect cell. A cell can be an arthropod cell. A cell can be a protozoan cell. A cell can be a helminth cell.

Suitable cells include a stem cell (e.g. an embryonic stem (ES) cell, an induced pluripotent stem (iPS) cell; a germ cell (e.g., an oocyte, a sperm, an oogonia, a spermatogonia, etc.); a somatic cell, e.g. a fibroblast, an oligodendrocyte, a glial cell, a hematopoietic cell, a neuron, a muscle cell, a bone cell, a hepatocyte, a pancreatic cell, etc.

Suitable cells include human embryonic stem cells, fetal cardiomyocytes, myofibroblasts, mesenchymal stem cells, autotransplanted expanded cardiomyocytes, adipocytes, totipotent cells, pluripotent cells, blood stem cells, myoblasts, adult stem cells, bone marrow cells, mesenchymal cells, embryonic stem cells, parenchymal cells, epithelial cells, endothelial cells, mesothelial cells, fibroblasts, osteoblasts, chondrocytes, exogenous cells, endogenous cells, stem cells, hematopoietic stem cells, bone-marrow derived progenitor cells, myocardial cells, skeletal cells, fetal cells, undifferentiated cells, multi-potent progenitor cells, unipotent progenitor cells, monocytes, cardiac myoblasts, skeletal myoblasts, macrophages, capillary endothelial cells, xenogenic cells, allogenic cells, and post-natal stem cells.

In some cases, the cell is an immune cell, a neuron, an epithelial cell, and endothelial cell, or a stem cell. In some cases, the immune cell is a T cell, a B cell, a monocyte, a natural killer cell, a dendritic cell, or a macrophage. In some cases, the immune cell is a cytotoxic T cell. In some cases, the immune cell is a helper T cell. In some cases, the immune cell is a regulatory T cell (Treg).

In some cases, the cell is a stem cell. Stem cells include adult stem cells. Adult stem cells are also referred to as somatic stem cells.

Adult stem cells are resident in differentiated tissue, but retain the properties of self-renewal and ability to give rise to multiple cell types, usually cell types typical of the tissue in which the stem cells are found. Numerous examples of somatic stem cells are known to those of skill in the art, including muscle stem cells; hematopoietic stem cells; epithelial stem cells; neural stem cells; mesenchymal stem cells; mammary stem cells; intestinal stem cells; mesodermal stem cells; endothelial stem cells; olfactory stem cells; neural crest stem cells; and the like.

Stem cells of interest include mammalian stem cells, where the term "mammalian" refers to any animal classified as a mammal, including humans; non-human primates; domestic and farm animals; and zoo, laboratory, sports, or pet animals, such as dogs, horses, cats, cows, mice, rats, rabbits, etc. In some cases, the stem cell is a human stem cell. In some cases, the stem cell is a rodent (e.g., a mouse; a rat) stem cell. In some cases, the stem cell is a non-human primate stem cell.

Stem cells can express one or more stem cell markers, e.g., SOX9, KRT19, KRT7, LGR5, CA9, FXYD2, CDH6, CLDN18, TSPAN8, BPIFB1, OLFM4, CDH17, and PPARGC1A.

In some embodiments, the stem cell is a hematopoietic stem cell (HSC). HSCs are mesoderm-derived cells that can be isolated from bone marrow, blood, cord blood, fetal liver and yolk sac. HSCs are characterized as CD34+ and CD3$^-$. HSCs can repopulate the erythroid, neutrophil-macrophage, megakaryocyte and lymphoid hematopoietic cell lineages in vivo. In vitro, HSCs can be induced to undergo at least some self-renewing cell divisions and can be induced to differentiate to the same lineages as is seen in vivo. As such, HSCs can be induced to differentiate into one or more of erythroid cells, megakaryocytes, neutrophils, macrophages, and lymphoid cells.

In other embodiments, the stem cell is a neural stem cell (NSC). Neural stem cells (NSCs) are capable of differentiating into neurons, and glia (including oligodendrocytes, and astrocytes). A neural stem cell is a multipotent stem cell which is capable of multiple divisions, and under specific conditions can produce daughter cells which are neural stem cells, or neural progenitor cells that can be neuroblasts or glioblasts, e.g., cells committed to become one or more types of neurons and glial cells respectively. Methods of obtaining NSCs are known in the art.

In other embodiments, the stem cell is a mesenchymal stem cell (MSC). MSCs originally derived from the embryonal mesoderm and isolated from adult bone marrow, can differentiate to form muscle, bone, cartilage, fat, marrow stroma, and tendon. Methods of isolating MSC are known in the art; and any known method can be used to obtain MSC. See, e.g., U.S. Pat. No. 5,736,396, which describes isolation of human MSC.

A cell is in some cases a plant cell. A plant cell can be a cell of a monocotyledon. A cell can be a cell of a dicotyledon.

In some cases, the cell is a plant cell. For example, the cell can be a cell of a major agricultural plant, e.g., Barley, Beans (Dry Edible), Canola, Corn, Cotton (Pima), Cotton (Upland), Flaxseed, Hay (Alfalfa), Hay (Non-Alfalfa), Oats, Peanuts, Rice, Sorghum, Soybeans, Sugarbeets, Sugarcane, Sunflowers (Oil), Sunflowers (Non-Oil), Sweet Potatoes, Tobacco (Burley), Tobacco (Flue-cured), Tomatoes, Wheat (Durum), Wheat (Spring), Wheat (Winter), and the like. As another example, the cell is a cell of a vegetable crops which include but are not limited to, e.g., alfalfa sprouts, aloe leaves, arrow root, arrowhead, artichokes, asparagus, bamboo shoots, banana flowers, bean sprouts, beans, beet tops, beets, bittermelon, bok choy, broccoli, broccoli rabe (*rappini*), brussels sprouts, cabbage, cabbage sprouts, cactus leaf (nopales), calabaza, cardoon, carrots, cauliflower, celery, chayote, chinese artichoke (crosnes), chinese cabbage, chinese celery, chinese chives, choy sum, *chrysanthemum* leaves (tung ho), collard greens, corn stalks, corn-sweet, cucumbers, daikon, dandelion greens, dasheen, dau mue (pea tips), donqua (winter melon), eggplant, endive, escarole, fiddle head ferns, field cress, frisee, gai choy (chinese mustard), gailon, galanga (siam, thai ginger), garlic, ginger root, gobo, greens, hanover salad greens, huauzontle, jerusalem artichokes, jicama, kale greens, kohlrabi, lamb's quarters (quilete), lettuce (bibb), lettuce (boston), lettuce (boston red), lettuce (green leaf), lettuce (iceberg), lettuce (lolla rossa), lettuce (oak leaf—green), lettuce (oak leaf—red), lettuce (processed), lettuce (red leaf), lettuce (romaine), lettuce (ruby romaine), lettuce (russian red mustard), linkok, lo bok, long beans, lotus root, mache, maguey (agave) leaves, malanga, mesculin mix, mizuna, moap (smooth luffa), moo, moqua (fuzzy squash), mushrooms, mustard, nagaimo, okra, ong choy, onions green, opo (long squash), ornamental corn, ornamental gourds, parsley, parsnips, peas, peppers (bell type), peppers, pumpkins, radicchio, radish sprouts, radishes, rape greens, rape greens, rhubarb, romaine (baby red), rutabagas, salicornia (sea bean), sinqua (angled/ridged luffa), spinach, squash, straw bales, sugarcane, sweet potatoes, swiss chard, tamarindo, taro, taro leaf, taro shoots, tatsoi, tepeguaje (guaje), tindora, tomatillos, tomatoes, tomatoes (cherry), tomatoes (grape type), tomatoes (plum type), tumeric, turnip tops greens, turnips, water chestnuts, yampi, yams (names), yu choy, yuca (cassava), and the like.

A cell is in some cases an arthropod cell. For example, the cell can be a cell of a sub-order, a family, a sub-family, a group, a sub-group, or a species of, e.g., Chelicerata, Myriapodia, Hexipodia, Arachnida, Insecta, Archaeognatha, Thysanura, Palaeoptera, Ephemeroptera, Odonata, Anisoptera, Zygoptera, Neoptera, Exopterygota, Plecoptera, Embioptera, Orthoptera, Zoraptera, Dermaptera, Dictyoptera, Notoptera, Glylloblattidae, Mantophasmatidae, Phasmatodea, Blattaria, Isoptera, Mantodea, Parapneuroptera, Psocoptera, Thysanoptera, Phthiraptera, Hemiptera, Endopterygota or Holometabola, Hymenoptera, Coleoptera, Strepsiptera, Raphidioptera, Megaloptera, Neuroptera, Mecoptera, Siphonaptera, Diptera, Trichoptera, or Lepidoptera.

A cell is in some cases an insect cell. For example, in some cases, the cell is a cell of a mosquito, a grasshopper, a true bug, a fly, a flea, a bee, a wasp, an ant, a louse, a moth, or a beetle.

Donor Polynucleotide (Donor Template)

Guided by a CRISPR/Cas guide RNA, a Class 2 CRISPR/Cas effector protein in some cases generates site-specific double strand breaks (DSBs) or single strand breaks (SSBs) (e.g., when the Class 2 CRISPR/Cas effector protein is a nickase variant) within double-stranded DNA (dsDNA) target nucleic acids, which are repaired either by non-homologous end joining (NHEJ) or homology-directed recombination (HDR).

In some cases, contacting a target DNA (with a Class 2 CRISPR/Cas effector protein and a CRISPR/Cas guide RNA) occurs under conditions that are permissive for non-homologous end joining or homology-directed repair. Thus, in some cases, a subject method includes contacting the target DNA with a donor polynucleotide (e.g., by introducing the donor polynucleotide into a cell), wherein the donor polynucleotide, a portion of the donor polynucleotide, a copy of the donor polynucleotide, or a portion of a copy of the donor polynucleotide integrates into the target DNA. In some cases, the method does not comprise contacting a cell with a donor polynucleotide, and the target DNA is modified such that nucleotides within the target DNA are deleted.

In some cases, a CRISPR/Cas trancRNA (or nucleic acid encoding same), a CRISPR/Cas guide RNA (or nucleic acid encoding same), and/or a Class 2 CRISPR/Cas effector protein (or a nucleic acid encoding same, such as an RNA or a DNA, e.g., one or more expression vectors) are coadministered (e.g., contacted with a target nucleic acid, administered to cells, etc.) with a donor polynucleotide sequence that includes at least a segment with homology to the target DNA sequence, the subject methods may be used to add, i.e. insert or replace, nucleic acid material to a target DNA sequence (e.g. to "knock in" a nucleic acid, e.g., one that encodes for a protein, an siRNA, an miRNA, etc.), to add a tag (e.g., 6×His, a fluorescent protein (e.g., a green fluorescent protein; a yellow fluorescent protein, etc.), hemagglutinin (HA), FLAG, etc.), to add a regulatory sequence to a gene (e.g. promoter, polyadenylation signal, internal ribosome entry sequence (IRES), 2A peptide, start codon, stop codon, splice signal, localization signal, etc.), to modify a nucleic acid sequence (e.g., introduce a mutation, remove a disease causing mutation by introducing a correct sequence), and the like. As such, a complex comprising a CRISPR/Cas guide RNA and Class 2 CRISPR/Cas effector protein (or CRISPR/Cas guide RNA and CRISPR/Cas trancRNA and Class 2 CRISPR/Cas effector protein) is useful in any in vitro or in vivo application in which it is desirable to modify DNA in a site-specific, i.e. "targeted", way, for example gene knock-out, gene knock-in, gene editing, gene tagging, etc., as used in, for example, gene therapy, e.g. to treat a disease or as an antiviral, antipathogenic, or anticancer therapeutic, the production of genetically modified organisms in agriculture, the large scale production of proteins by cells for therapeutic, diagnostic, or research purposes, the induction of iPS cells, biological research, the targeting of genes of pathogens for deletion or replacement, etc.

In applications in which it is desirable to insert a polynucleotide sequence into he genome where a target sequence is cleaved, a donor polynucleotide (a nucleic acid comprising a donor sequence) can also be provided to the cell. By a "donor sequence" or "donor polynucleotide" or "donor template" it is meant a nucleic acid sequence to be inserted at the site cleaved by the Class 2 CRISPR/Cas effector protein (e.g., after dsDNA cleavage, after nicking a target DNA, after dual nicking a target DNA, and the like). The donor polynucleotide can contain sufficient homology to a genomic sequence at the target site, e.g. 70%, 80%, 85%, 90%, 95%, or 100% homology with the nucleotide sequences flanking the target site, e.g. within about 50 bases or less of the target site, e.g. within about 30 bases, within about 15 bases, within about 10 bases, within about 5 bases, or immediately flanking the target site, to support homology-directed repair between it and the genomic sequence to which it bears homology. Approximately 25, 50, 100, or 200 nucleotides, or more than 200 nucleotides, of sequence homology between a donor and a genomic sequence (or any integral value between 10 and 200 nucleotides, or more) can support homology-directed repair. Donor polynucleotides can be of any length, e.g. 10 nucleotides or more, 50 nucleotides or more, 100 nucleotides or more, 250 nucleotides or more, 500 nucleotides or more, 1000 nucleotides or more, 5000 nucleotides or more, etc.

The donor sequence is typically not identical to the genomic sequence that it replaces. Rather, the donor sequence may contain at least one or more single base changes, insertions, deletions, inversions or rearrangements with respect to the genomic sequence, so long as sufficient homology is present to support homology-directed repair (e.g., for gene correction, e.g., to convert a disease-causing base pair of a non disease-causing base pair). In some embodiments, the donor sequence comprises a non-homologous sequence flanked by two regions of homology, such that homology-directed repair between the target DNA region and the two flanking sequences results in insertion of the non-homologous sequence at the target region. Donor sequences may also comprise a vector backbone containing sequences that are not homologous to the DNA region of interest and that are not intended for insertion into the DNA region of interest. Generally, the homologous region(s) of a donor sequence will have at least 50% sequence identity to a genomic sequence with which recombination is desired. In certain embodiments, 60%, 70%, 80%, 90%, 95%, 98%, 99%, or 99.9% sequence identity is present. Any value between 1% and 100% sequence identity can be present, depending upon the length of the donor polynucleotide.

The donor sequence may comprise certain sequence differences as compared to the genomic sequence, e.g. restriction sites, nucleotide polymorphisms, selectable markers (e.g., drug resistance genes, fluorescent proteins, enzymes etc.), etc., which may be used to assess for successful insertion of the donor sequence at the cleavage site or in some cases may be used for other purposes (e.g., to signify expression at the targeted genomic locus). In some cases, if located in a coding region, such nucleotide sequence differences will not change the amino acid sequence, or will make silent amino acid changes (i.e., changes which do not affect the structure or function of the protein). Alternatively, these sequences differences may include flanking recombination sequences such as FLPs, loxP sequences, or the like, that can be activated at a later time for removal of the marker sequence.

In some cases, the donor sequence is provided to the cell as single-stranded DNA. In some cases, the donor sequence is provided to the cell as double-stranded DNA. It may be introduced into a cell in linear or circular form. If introduced in linear form, the ends of the donor sequence may be protected (e.g., from exonucleolytic degradation) by any convenient method and such methods are known to those of skill in the art. For example, one or more dideoxynucleotide residues can be added to the 3' terminus of a linear molecule and/or self-complementary oligonucleotides can be ligated to one or both ends. See, for example, Chang et al. (1987) Proc. Natl. Acad Sci USA 84:4959-4963: Nehls et al. (1996) Science 272:886-889. Additional methods for protecting exogenous polynucleotides from degradation include, but are not limited to, addition of terminal amino group(s) and the use of modified internucleotide linkages such as, for example, phosphorothioates, phosphoramidates, and O-methyl ribose or deoxyribose residues. As an alternative to protecting the termini of a linear donor sequence, additional lengths of sequence may be included outside of the regions of homology that can be degraded without impacting recombination. A donor sequence can be introduced into a cell as part of a vector molecule having additional sequences such as, for example, replication origins, promoters and genes encoding antibiotic resistance. Moreover, donor sequences can be introduced as naked nucleic acid, as nucleic acid complexed with an agent such as a liposome or poloxamer, or can be delivered by viruses (e.g., adenovirus, AAV), as described elsewhere herein for nucleic acids encoding a CRISPR/Cas guide RNA and/or a Class 2 CRISPR/Cas effector fusion polypeptide and/or donor polynucleotide.

Transgenic, Non-Human Organisms

As described above, in some cases, a nucleic acid (e.g., a recombinant expression vector) of the present disclosure (e.g., a nucleic acid comprising a nucleotide sequence encoding a Class 2 CRISPR/Cas effector protein; a nucleic acid comprising a nucleotide sequence encoding a Class 2 CRISPR/Cas effector fusion polypeptide; etc.), is used as a transgene to generate a transgenic non-human organism that produces a Class 2 CRISPR/Cas effector protein, or a Class 2 CRISPR/Cas effector fusion polypeptide, of the present disclosure. The present disclosure provides a transgenic-non-human organism comprising a nucleotide sequence encoding a Class 2 CRISPR/Cas effector protein or a Class 2 CRTSPR/Cas effector fusion polypeptide. The present disclosure provides a transgenic-non-human organism comprising a nucleotide sequence encoding a CRISPR/Cas trancRNA.

Transgenic, Non-Human Animals

In some embodiments, the genome of the transgenic non-human animal comprises a nucleotide sequence encoding a Class 2 CRISPR/Cas effector protein, e or a Class 2 CRISPR/Cas effector fusion polypeptide. In some embodiments, the genome of the transgenic non-human animal comprises a nucleotide sequence encoding a CRISPR/Cas trancRNA. In some cases, the transgenic non-human animal is homozygous for the genetic modification. In some cases, the transgenic non-human animal is heterozygous for the genetic modification. In some embodiments, the transgenic non-human animal is a vertebrate, for example, a fish (e.g., salmon, trout, zebra fish, gold fish, puffer fish, cave fish, etc.), an amphibian (frog, newt, salamander, etc.), a bird (e.g., chicken, turkey, etc.), a reptile (e.g., snake, lizard, etc.), a non-human mammal (e.g., an ungulate, e.g., a pig, a cow, a goat, a sheep, etc.; a lagomorph (e.g., a rabbit); a rodent (e.g., a rat, a mouse); a non-human primate; etc.), etc. In some cases, the transgenic non-human animal is an invertebrate. In some cases, the transgenic non-human animal is an insect (e.g., a mosquito; an agricultural pest; etc.). In some cases, the transgenic non-human animal is an arachnid.

Nucleotide sequences encoding a Class 2 CRISPR/Cas effector protein, e or a Class 2 CRISPR/Cas effector fusion polypeptide or a CRISPR/Cas trancRNAcan be under the control of (i.e., operably linked to) an unknown promoter (e.g., when the nucleic acid randomly integrates into a host cell genome) or can be under the control of (i.e., operably linked to) a known promoter. Suitable known promoters can be any known promoter and include constitutively active promoters (e.g., CMV promoter), inducible promoters (e.g., heat shock promoter, tetracycline-regulated promoter, steroid-regulated promoter, metal-regulated promoter, estrogen receptor-regulated promoter, etc.), spatially restricted and/or temporally restricted promoters (e.g., a tissue specific promoter, a cell type specific promoter, etc.), etc.

Transgenic Plants

As described above, in some cases, a nucleic acid (e.g., a recombinant expression vector) of the present disclosure (e.g., a nucleic acid comprising a nucleotide sequence encoding a Class 2 CRISPR/Cas effector protein of the present disclosure; a nucleic acid comprising a nucleotide sequence encoding a Class 2 CRISPR/Cas effector fusion polypeptide of the present disclosure; a nucleic acid comprising a nucleotide sequence encoding a Class 2 CRISPR/Cas trancRNA, etc.), is used as a transgene to generate a transgenic plant that produces a Class 2 CRISPR/Cas effector protein, a Class 2 CRISPR/Cas effector fusion polypeptide, a CRISPR/Cas trancRNA, and the like. The present disclosure provides a transgenic plant comprising a nucleotide sequence encoding a Class 2 CRISPR/Cas effector protein, and/or a Class 2 CRISPR/Cas effector fusion polypeptide, and/or a CRISPR/Cas trancRNA. In some embodiments, the genome of the transgenic plant comprises a subject nucleic acid. In some embodiments, the transgenic plant is homozygous for the genetic modification. In some embodiments, the transgenic plant is heterozygous for the genetic modification.

Methods of introducing exogenous nucleic acids into plant cells are well known in the art. Such plant cells are considered "transformed," as defined above. Suitable methods include viral infection (such as double stranded DNA viruses), transfection, conjugation, protoplast fusion, electroporation, particle gun technology, calcium phosphate precipitation, direct microinjection, silicon carbide whiskers technology, Agrobacterium-mediated transformation and the like. The choice of method is generally dependent on the type of cell being transformed and the circumstances under which the transformation is taking place (i.e. in vitro, ex vivo, or in vivo).

Transformation methods based upon the soil bacterium Agrobacterium tumefaciens are particularly useful for introducing an exogenous nucleic acid molecule into a vascular plant. The wild type form of Agrobacterium contains a Ti (tumor-inducing) plasmid that directs production of tumorigenic crown gall growth on host plants. Transfer of the tumor-inducing T-DNA region of the Ti plasmid to a plant genome requires the Ti plasmid-encoded virulence genes as well as T-DNA borders, which are a set of direct DNA repeats that delineate the region to be transferred. An Agrobacterium-based vector is a modified form of a Ti plasmid, in which the tumor inducing functions are replaced by the nucleic acid sequence of interest to be introduced into the plant host.

Agrobacterium-mediated transformation generally employs cointegrate vectors or binary vector systems, in which the components of the Ti plasmid are divided between a helper vector, which resides permanently in the Agrobacterium host and carries the virulence genes, and a shuttle vector, which contains the gene of interest bounded by T-DNA sequences. A variety of binary vectors is well known in the art and are commercially available, for example, from Clontech (Palo Alto, Calif.). Methods of coculturing Agrobacterium with cultured plant cells or wounded tissue such as leaf tissue, root explants, hypocotyledons, stem pieces or tubers, for example, also are well known in the art. See, e.g., Glick and Thompson, (eds.), Methods in Plant Molecular Biology and Biotechnology, Boca Raton, Fla.: CRC Press (1993).

Microprojectile-mediated transformation also can be used to produce a subject transgenic plant. This method, first described by Klein et al. (Nature 327:70-73 (1987)), relies on microprojectiles such as gold or tungsten that are coated with the desired nucleic acid molecule by precipitation with calcium chloride, spermidine or polyethylene glycol. The microprojectile particles are accelerated at high speed into an angiosperm tissue using a device such as the BIOLISTIC PD-1000 (Biorad; Hercules Calif.).

A nucleic acid of the present disclosure (e.g., a nucleic acid (e.g., a recombinant expression vector) comprising a nucleotide sequence encoding a Class 2 CRISPR/Cas effector protein, or a Class 2 CRISPR/Cas effector fusion polypeptide, of the present disclosure) may be introduced into a plant in a manner such that the nucleic acid is able to enter a plant cell(s), e.g., via an in vivo or ex vivo protocol. By "in vivo," it is meant in the nucleic acid is administered to a living body of a plant e.g. infiltration. By "ex vivo" it is meant that cells or explants are modified outside of the plant, and then such cells or organs are regenerated to a plant. A number of vectors suitable for stable transformation of plant cells or for the establishment of transgenic plants have been described, including those described in Weissbach and Weissbach, (1989) Methods for Plant Molecular Biology Academic Press, and Gelvin et al., (1990) Plant Molecular Biology Manual, Kluwer Academic Publishers. Specific examples include those derived from a Ti plasmid of Agrobacterium tumefaciens, as well as those disclosed by Herrera-Estrella et al. (1983) Nature 303: 209, Bevan (1984) Nucl Acid Res. 12: 8711-8721, Klee (1985) Bio/Technolo 3: 637-642. Alternatively, non-Ti vectors can be used to transfer the DNA into plants and cells by using free DNA delivery techniques. By using these methods transgenic plants such as wheat, rice (Christou (1991) Bio/Technology 9:957-9 and 4462) and corn (Gordon-Kamm (1990) Plant Cell 2: 603-618) can be produced. An immature embryo can also be a good target tissue for monocots for direct DNA delivery techniques by using the particle gun (Weeks et al. (1993) Plant Physiol 102: 1077-1084; Vasil (1993) Bio/Technolo 10: 667-674; Wan and Lemeaux (1994) Plant Physiol 104: 37-48 and for Agrobacterium-mediated DNA transfer (Ishida et al. (1996) Nature Biotech 14: 745-750). Exemplary methods for introduction of DNA into chloroplasts are biolistic bombardment, polyethylene glycol transformation of protoplasts, and microinjection (Danieli et al Nat. Biotechnol 16:345-348, 1998; Staub et al Nat. Biotechnol 18: 333-338, 2000; O'Neill et al Plant J. 3:729-738, 1993; Knoblauch et al Nat. Biotechnol 17: 906-909; U.S. Pat. Nos. 5,451,513, 5,545,817, 5,545,818, and 5,576,198; in Intl. Application No. WO 95/16783; and in Boynton et al., Methods in Enzymology 217: 510-536 (1993), Svab et al., Proc. Natl. Acad. Sci. USA 90: 913-917 (1993), and McBride et al., Proc. Natl. Acad. Sci. USA 91: 7301-7305 (1994)). Any vector suitable for the methods of biolistic bombardment, polyethylene glycol transformation of protoplasts and microinjection will be suitable as a targeting vector for chloroplast transformation. Any double stranded DNA vector may be used as a transformation vector, especially when the method of introduction does not utilize *Agrobacterium*.

Plants which can be genetically modified include grains, forage crops, fruits, vegetables, oil seed crops, palms, forestry, and vines. Specific examples of plants which can be modified follow: maize, banana, peanut, field peas, sunflower, tomato, canola, tobacco, wheat, barley, oats, potato, soybeans, cotton, carnations, sorghum, lupin and rice.

The present disclosure provides transformed plant cells, tissues, plants and products that contain the transformed plant cells. A feature of the subject transformed cells, and tissues and products that include the same is the presence of a subject nucleic acid integrated into the genome, and production by plant cells of a Class 2 CRISPR/Cas effector protein, or a Class 2 CRISPR/Cas effector fusion polypeptide, of the present disclosure. Recombinant plant cells of the present invention are useful as populations of recombinant cells, or as a tissue, seed, whole plant, stem, fruit, leaf, root, flower, stem, tuber, grain, animal feed, a field of plants, and the like.

Nucleotide sequences encoding a Class 2 CRISPR/Cas effector protein, or a Class 2 CRTSPR/Cas effector fusion polypeptide, of the present disclosure can be under the control of (i.e., operably linked to) an unknown promoter (e.g., when the nucleic acid randomly integrates into a host cell genome) or can be under the control of (i.e., operably linked to) a known promoter. Suitable known promoters can be any known promoter and include constitutively active promoters, inducible promoters, spatially restricted and/or temporally restricted promoters, etc.

Examples of Non-Limiting Aspects of the Disclosure

Aspects, including embodiments, of the present subject matter described above may be beneficial alone or in combination, with one or more other aspects or embodiments. Without limiting the foregoing description, certain non-limiting aspects of the disclosure, numbered 1-36 are provided below. As will be apparent to those of skill in the art upon reading this disclosure, each of the individually numbered aspects may be used or combined with any of the preceding or following individually numbered aspects. This is intended to provide support for all such combinations of aspects and is not limited to combinations of aspects explicitly provided below:

Aspects

Aspect 1. A method of guiding a Class 2 CRISPR/Cas effector protein to a target sequence of a target nucleic acid, the method comprising contacting the target nucleic acid with an engineered and/or non-naturally occurring complex comprising: (a) a Class 2 CRISPR/Cas effector protein; (b) a guide RNA that comprises a guide sequence that hybridizes to a target sequence of the target nucleic acid, and comprises a region that binds to the Class 2 CRISPR/Cas effector protein; and (c) a CRISPR/Cas transactivating noncoding RNA (trancRNA).

Aspect 2. The method of aspect 1, wherein the method results in modification of the target nucleic acid, modulation of transcription from the target nucleic acid, or modification of a polypeptide associated with a target nucleic acid.

Aspect 3. The method of aspect 2, wherein the target nucleic acid is modified by being cleaved.

Aspect 4. The method of any one of aspects 1-3, wherein the target nucleic acid is selected from: double stranded DNA, single stranded DNA, RNA, genomic DNA, and extrachromosomal DNA.

Aspect 5. The method of any one of aspects 1-4, wherein the guide sequence and the region that binds to the Class 2 CRISPR/Cas effector protein are heterologous to one another.

Aspect 6. The method of any one of aspects 1-5, wherein said contacting results in genome editing.

Aspect 7. The method of any one of aspects 1-5, wherein said contacting takes place outside of a bacterial cell and outside of an archaeal cell.

Aspect 8. The method of any one of aspects 1-5, wherein said contacting takes place in vitro outside of a cell.

Aspect 9. The method of any one of aspects 1-7, wherein said contacting takes place inside of a target cell.

Aspect 10. The method of aspect 9, wherein said contacting comprises: introducing into the target cell at least one of: (a) the Class 2 CRISPR/Cas effector protein, or a nucleic acid encoding the Class 2 CRISPR/Cas effector protein; (b) the guide RNA, or a nucleic acid encoding the guide RNA; and (c) the CRISPR/Cas trancRNA, or a nucleic acid encoding the CRISPR/Cas trancRNA.

Aspect 11. The method of aspect 10, wherein the nucleic acid encoding the Class 2 CRISPR/Cas effector protein is a non-naturally sequence that is codon optimized for expression in the target cell.

Aspect 12. The method of any one of aspects 9-11, wherein the target cell is a eukaryotic cell.

Aspect 13. The method of any one of aspects 9-12, wherein the target cell is in culture in vitro.

Aspect 14. The method of any one of aspects 9-12, wherein the target cell is in vivo.

Aspect 15. The method of any one of aspects 9-12, wherein the target cell is ex vivo.

Aspect 16. The method of aspect 12, wherein the eukaryotic cell is selected from the group consisting of: a plant cell, a fungal cell, a single cell eukaryotic organism, a mammalian cell, a reptile cell, an insect cell, an avian cell, a fish cell, a parasite cell, an arthropod cell, a cell of an invertebrate, a cell of a vertebrate, a rodent cell, a mouse cell, a rat cell, a primate cell, a non-human primate cell, and a human cell.

Aspect 17. The method of any one of aspects 9-16, wherein said contacting further comprises: introducing a DNA donor template into the target cell.

Aspect 18. The method of any one of aspects 1-17, wherein the trancRNA comprises a nucleotide sequence having 70% or more identity with a trancRNA sequence set forth in Table 2.

Aspect 19. A composition comprising an engineered and/or non-naturally occurring complex comprising: (a) a Class 2 CRISPR/Cas effector protein, or a nucleic acid encoding said Class 2 CRISPR/Cas effector protein; (b) a guide RNA, or a nucleic acid encoding said guide RNA, wherein said guide RNA comprises a guide sequence that is complementary to a target sequence of a target nucleic acid, and comprises a region that can bind to the Class 2 CRISPR/Cas effector protein; and (c) a CRISPR/Cas transactivating noncoding RNA (trancRNA), or a nucleic acid encoding said CRISPR/Cas trancRNA.

Aspect 20. A kit comprising an engineered and/or non-naturally occurring complex comprising: (a) a Class 2 CRISPR/Cas effector protein, or a nucleic acid encoding said Class 2 CRISPR/Cas effector protein; (b) a guide RNA, or a nucleic acid encoding said guide RNA, wherein said guide RNA comprises a guide sequence that is complementary to a target sequence of a target nucleic acid, and comprises a region that can hind to the Class 2 CRTSPR/Cas effector protein; and (c) a CRISPR/Cas transactivating noncoding RNA (trancRNA), or a nucleic acid encoding said CRISPR/Cas trancRNA.

Aspect 21. A genetically modified eukaryotic cell, comprising at least one of: (a) a Class 2 CRISPR/Cas effector protein, or a nucleic acid encoding said Class 2 CRISPR/Cas effector protein; (b) a guide RNA, or a nucleic acid encoding said guide RNA, wherein said guide RNA comprises a guide sequence that is complementary to a target sequence of a target nucleic acid, and comprises a region that can bind to the Class 2 CRISPR/Cas effector protein; and (c) a CRISPR/Cas transactivating noncoding RNA (trancRNA), or a nucleic acid encoding said CRISPR/Cas trancRNA.

Aspect 22. The composition, kit, or eukaryotic cell of any one of the preceding aspects, characterized by at least one of: (a) the nucleic acid encoding said Class 2 CRISPR/Cas effector protein comprises a nucleotide sequence that: (i) encodes the Class 2 CRISPR/Cas effector protein and, (ii) is operably linked to a heterologous promoter; (b) the nucleic acid encoding said guide RNA comprises a nucleotide sequence that: (i) encodes the guide RNA and, (ii) is operably linked to a heterologous promoter; and (c) the nucleic acid encoding said CRISPR/Cas trancRNA comprises a nucleotide sequence that: (i) encodes the CRISPR/Cas trancRNA and, (ii) is operably linked to a heterologous promoter.

Aspect 23. The composition, kit, or eukaryotic cell of any one of the preceding aspects, for use in a method of therapeutic treatment of a patient.

Aspect 24. The method, composition, kit, or eukaryotic cell of any one of the preceding aspects, wherein at least one of: the nucleic acid encoding said Class 2 CRISPR/Cas effector protein, the nucleic acid encoding said guide RNA, and the nucleic acid encoding said CRISPR/Cas trancRNA, is a recombinant expression vector.

Aspect 25. The method, composition, kit, or eukaryotic cell of any one of the preceding aspects, wherein the guide RNA and/or the CRISPR/Cas trancRNA comprises one or more of: a modified nucleobase, a modified backbone or non-natural internucleoside linkage, a modified sugar moiety, a Locked Nucleic Acid, a Peptide Nucleic Acid, and a deoxyribonucleotide.

Aspect 26. The method, composition, kit, or eukaryotic cell of any one of the preceding aspects, wherein the Class 2 CRISPR/Cas effector protein is a variant Class 2 CRISPR/Cas effector protein with reduced nuclease activity compared to a corresponding wild type Cas12c protein.

Aspect 27. The method, composition, kit, or eukaryotic cell of any one of the preceding aspects, wherein at least one of: the Class 2 CRISPR/Cas effector protein, the nucleic acid encoding the Class 2 CRISPR/Cas effector protein, the guide RNA, the nucleic acid encoding the guide RNA, the CRISPR/Cas trancRNA, and the nucleic acid encoding the CRISPR/Cas trancRNA; is conjugated to a heterologous moiety.

Aspect 28. The method, composition, kit, or eukaryotic cell of aspect 27, wherein the heterologous moiety is a heterologous polypeptide.

Aspect 29. The method, composition, kit, or eukaryotic cell of any one of the preceding aspects, wherein the Class 2 CRISPR/Cas effector protein has reduced nuclease activity compared to a corresponding wild type Cas12c protein, and is fused to a heterologous polypeptide.

Aspect 30. The method, composition, kit, or eukaryotic cell of aspect 29, wherein the heterologous polypeptide: (i) has DNA modifying activity, (ii) exhibits the ability to increase or decrease transcription, and/or (iii) has enzymatic activity that modifies a polypeptide associated with DNA.

Aspect 31. The method, composition, kit, or eukaryotic cell of any one of the preceding aspects, wherein the Class 2 CRISPR/Cas effector protein comprises an amino acid sequence having 70% or more (at least 70%, at least 75%, at least 80%, at least 85%, at least 90%, at least 95%, at least 98%, at least 99%, or 100%) amino acid sequence identity with a Class 2 CRISPR/Cas effector of FIG. 1 or FIG. 29.

Aspect 32. The method, composition, kit, or eukaryotic cell of any one of the preceding aspects, wherein the Class 2 CRISPR/Cas effector protein is a CasZ protein.

Aspect 33. The method, composition, kit, or eukaryotic cell of aspect 32, wherein the CasZ protein is a CasZe, CasZf, CasZg, or CasZh protein.

Aspect 34. The method, composition, kit, or eukaryotic cell of any one of the preceding aspects, wherein the Class 2 CRISPR/Cas effector protein is a CasY protein.

Aspect 35. The method, composition, kit, or eukaryotic cell of any one of the preceding aspects, wherein the Class 2 CRISPR/Cas effector protein is a Cas12c protein.

Aspect 36. The method, composition, kit, or eukaryotic cell of any one of the preceding aspects, wherein the guide sequence and the region that binds to the Class 2 CRISPR/Cas effector protein are heterologous to one another.

Aspect 37. A method of detecting a target DNA in a sample, the method comprising: (a) contacting the sample with: (i) a Class 2 CRISPR/Cas effector protein; (ii) a guide RNA comprising: a region that binds to the Class 2 CRISPR/Cas effector protein, and a guide sequence that hybridizes with the target DNA; and (iii) a detector DNA that is single stranded and does not hybridize with the guide sequence of the guide RNA; and (b) measuring a detectable signal produced by cleavage of the single stranded detector DNA by the Class 2 CRISPR/Cas effector protein, thereby detecting the target DNA.

Aspect 38. The method of aspect 37, wherein the target DNA is single stranded.

Aspect 39. The method of aspect 37 or 38, wherein the target DNA is double stranded.

Aspect 40. The method of any one of aspects 37-39, wherein the target DNA is viral DNA.

Aspect 41. The method of any one of aspects 37-40, wherein the target DNA is papovavirus, hepdnavirus, herpesvirus, adenovirus, poxvirus, or parvovirus DNA.

Figure 7:
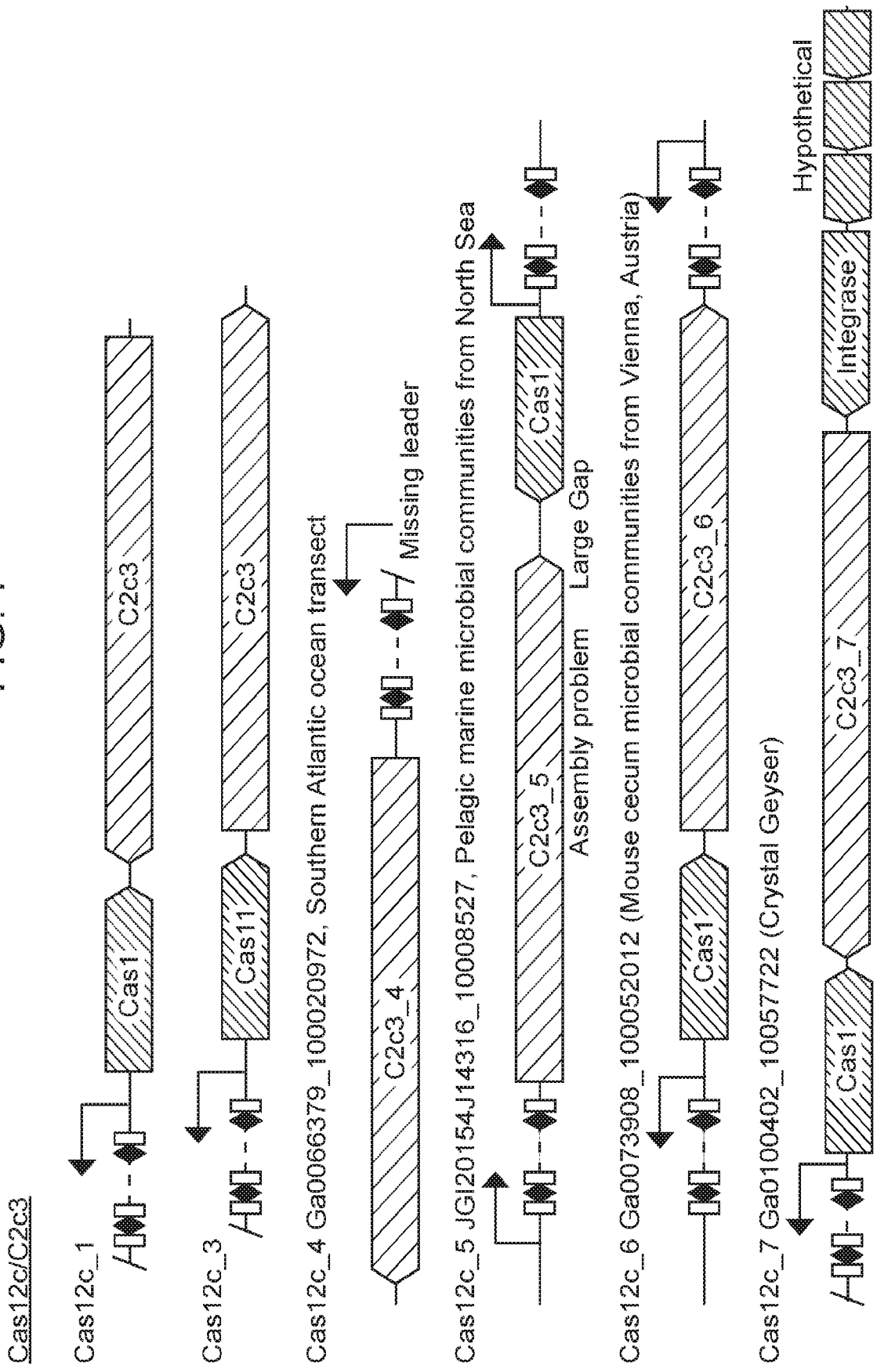
FIG. 7. depicts a schematic of natural Cas12c (C2c3) loci.

Aspect 42. The method of any one of aspects 37-41, wherein the Class 2 CRISPR/Cas effector protein polypeptide comprises an amino acid sequence having at least 85% amino acid sequence identity to the Class 2 CRISPR/Cas effector protein amino acid sequence set forth in any one of FIGS. 1 and 7.

Aspect 43. The method of any one of aspects 37-41, wherein the Class 2 CRISPR/Cas effector protein is a Cas14a polypeptide.

Aspect 44. The method according to any one of aspects 37-43, wherein the sample comprises DNA molecules from a cell lysate.

Aspect 45. The method according to any one of aspects 37-44, wherein the sample comprises cells.

Aspect 46. The method according to any one of aspects 37-45, wherein said contacting is carried out inside of a cell in vitro, ex vivo, or in vivo.

Aspect 47. The method according to aspect 46, wherein the cell is a eukaryotic cell.

Aspect 48. The method according to any one of aspects 37-47, wherein the target DNA can be detected at a concentration as low as 10 aM.

Aspect 49. The method according to any one of aspects 37-48, comprising determining an amount of the target DNA present in the sample.

Aspect 50. The method according to aspect 49, wherein said determining comprises: measuring the detectable signal to generate a test measurement; measuring a detectable signal produced by a reference sample or cell to generate a reference measurement; and comparing the test measurement to the reference measurement to determine an amount of target DNA present in the sample.

Aspect 51. The method according to any one of aspects 37-50, wherein measuring a detectable signal comprises one or more of: gold nanoparticle based detection, fluorescence polarization, colloid phase transition/dispersion, electrochemical detection, and semiconductor-based sensing.

Aspect 52. The method according to any one of aspects 37-51, wherein the single stranded detector DNA comprises a fluorescence-emitting dye pair.

Aspect 53. The method according to aspect 52, wherein the fluorescence-emitting dye pair produces an amount of detectable signal prior to cleavage of the single stranded detector DNA, and the amount of detectable signal is reduced after cleavage of the single stranded detector DNA.

Aspect 54. The method according to aspect 52, wherein the single stranded detector DNA produces a first detectable signal prior to being cleaved and a second detectable signal after cleavage of the single stranded detector DNA.

Aspect 55. The method according to any one of aspects 52-54, wherein the fluorescence-emitting dye pair is a fluorescence resonance energy transfer (FRET) pair.

Aspect 56. The method according to aspect 18, wherein an amount of detectable signal increases after cleavage of the single stranded detector DNA.

Aspect 57. The method according to aspect 52 or aspect 56, wherein the fluorescence-emitting dye pair is a quencher/fluor pair.

Aspect 58. The method according to any one of aspects 52-57, wherein the single stranded detector DNA comprises two or more fluorescence-emitting dye pairs.

Aspect 59. The method according to aspect 58, wherein said two or more fluorescence-emitting dye pairs include a fluorescence resonance energy transfer (FRET) pair and a quencher/fluor pair.

Aspect 60. The method according to any one of aspects 37-59, wherein the single stranded detector DNA comprises a modified nucleobase, a modified sugar moiety, and/or a modified nucleic acid linkage.

Aspect 61. The method according to any one of aspects 37-60, wherein the method comprises amplifying nucleic acids in the sample.

Aspect 62. The method according to aspect 61, wherein said amplifying comprises isothermal amplification.

Aspect 63. The method according to aspect 62, wherein the isothermal amplification comprises recombinase polymerase amplification (RPA).

Aspect 64. The method according to any one of aspects 61-63, wherein said amplifying begins prior to the contacting of step (a).

Aspect 65. The method according to any one of aspects 61-63, wherein said amplifying begins together with the contacting of step (a).

Aspect 66. A kit for detecting a target DNA in a sample, the kit comprising: (a) a guide RNA, or a nucleic acid encoding the guide RNA; wherein the guide RNA comprises: a region that binds to a Class 2 CRISPR/Cas effector protein, and a guide sequence that is complementary to a target DNA; and (b) a labeled detector DNA that is single stranded and does not hybridize with the guide sequence of the guide RNA.

Aspect 67. The kit of aspect 66, further comprising a Class 2 CRISPR/Cas effector protein.

Aspect 68. The kit of aspect 67, wherein the Class 2 CRISPR/Cas effector protein polypeptide comprises an amino acid sequence having at least 85% amino acid sequence identity to the Class 2 CRISPR/Cas effector protein amino acid sequence set forth in any one of FIGS. 1 and 29.

Aspect 69. The kit of aspect 67, wherein the Class 2 CRISPR/Cas effector protein is a Cas14a polypeptide.

Aspect 70. The kit of any one of aspects 66-69, wherein the single stranded detector DNA comprises a fluorescence-emitting dye pair.

Aspect 71. The kit of aspect 70, wherein the fluorescence-emitting dye pair is a FRET pair.

Aspect 72. The kit of aspect 70, wherein the fluorescence-emitting dye pair is a quencher/fluor pair.

Aspect 73. The kit of any one of aspects 70-72, wherein the single stranded detector DNA comprises two or more fluorescence-emitting dye pairs.

Aspect 74. The kit of aspect 73, wherein said two or more fluorescence-emitting dye pairs include a first fluorescence-emitting dye pair that produces a first detectable signal and a second fluorescence-emitting dye pair that produces a second detectable signal.

Aspect 75. The kit of any one of aspects 66-74, further comprising nucleic acid amplification components.

Aspect 76. The kit of aspect 75, wherein the nucleic acid amplification components are components for recombinase polymerase amplification (RPA).

Aspect 77. A method of cleaving single stranded DNAs (ssDNAs), the method comprising: contacting a population of nucleic acids, wherein said population comprises a target DNA and a plurality of non-target ssDNAs, with: (i) a Class 2 CRISPR/Cas effector protein; and (ii) a guide RNA comprising: a region that binds to the Class 2 CRISPR/Cas effector protein, and a guide sequence that hybridizes with the target DNA, wherein the Class 2 CRISPR/Cas effector protein cleaves non-target ssDNAs of said plurality.

Aspect 78. The method of aspect 77, wherein said contacting is inside of a cell in vitro, ex vivo, or in vivo.

Aspect 79. The method of aspect 78, wherein the cell is a eukaryotic cell.

Aspect 80. The method of aspect 79, wherein the eukaryotic cell is a plant cell.

Aspect 81. The method of any one of aspects 78-80, wherein the non-target ssDNAs are foreign to the cell.

Aspect 82. The method of aspect 81, wherein the non-target ssDNAs are viral DNAs.

Aspect 83. The method of any one of aspects 77-82, wherein the target DNA is single stranded.

Aspect 84. The method of any one of aspects 77-82, wherein the target DNA is double stranded.

Aspect 85. The method of any one of aspects 77-84, wherein the target DNA is viral DNA.

Aspect 86. The method of any one of aspects 77-84, wherein the target DNA is papovavirus, hepdnavirus, herpesvirus, adenovirus, poxvirus, or parvovirus DNA.

EXAMPLES

The following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Celsius, and pressure is at or near atmospheric. Standard abbreviations may be used, e.g., bp, base pair(s); kb, kilobase(s); pl, picoliter(s); s or sec, second(s); min, minute(s); h or hr, hour(s); aa, amino acid(s); kb, kilobase(s); bp, base pair(s); nt, nucleotide(s); i.m., intramuscular(ly); i.p., intraperitoneal (ly); s.c., subcutaneous(ly); and the like.

Example 1

FIG. 2. PAM depletion assays were conducted with Cas12c. E. coli containing the Cas12c CRISPR locus were transformed with a plasmid library with 7 nucleotides randomized 5' or 3' of the target sequence. The target plasmid was selected for and transformants were pooled. The randomized region was amplified and prepared for deep sequencing. Depleted sequences were identified and used to generate a PAM logo (depicted). Depending on the threshold used, the generated PAM logo for Cas12c_1 showed a preference for sequences containing a 5'-TA-3', 5'-TN-3', 5'-TR-3', 5'-HN-3', 5'-HR-3', 5'-MCTA-3', 5'-MCTR-3', 5'-CTA-3', or 5'-CTR-3' (where R is an A or G; and H is an A, C, or T; and M is C or A) flanking sequence 5' of the target and the non-target (NT) strand (also referred to as the non-complementary strand because it is not the strand that hybridizes with the guide RNA). A 3' PAM was not detected.

Figure 3:
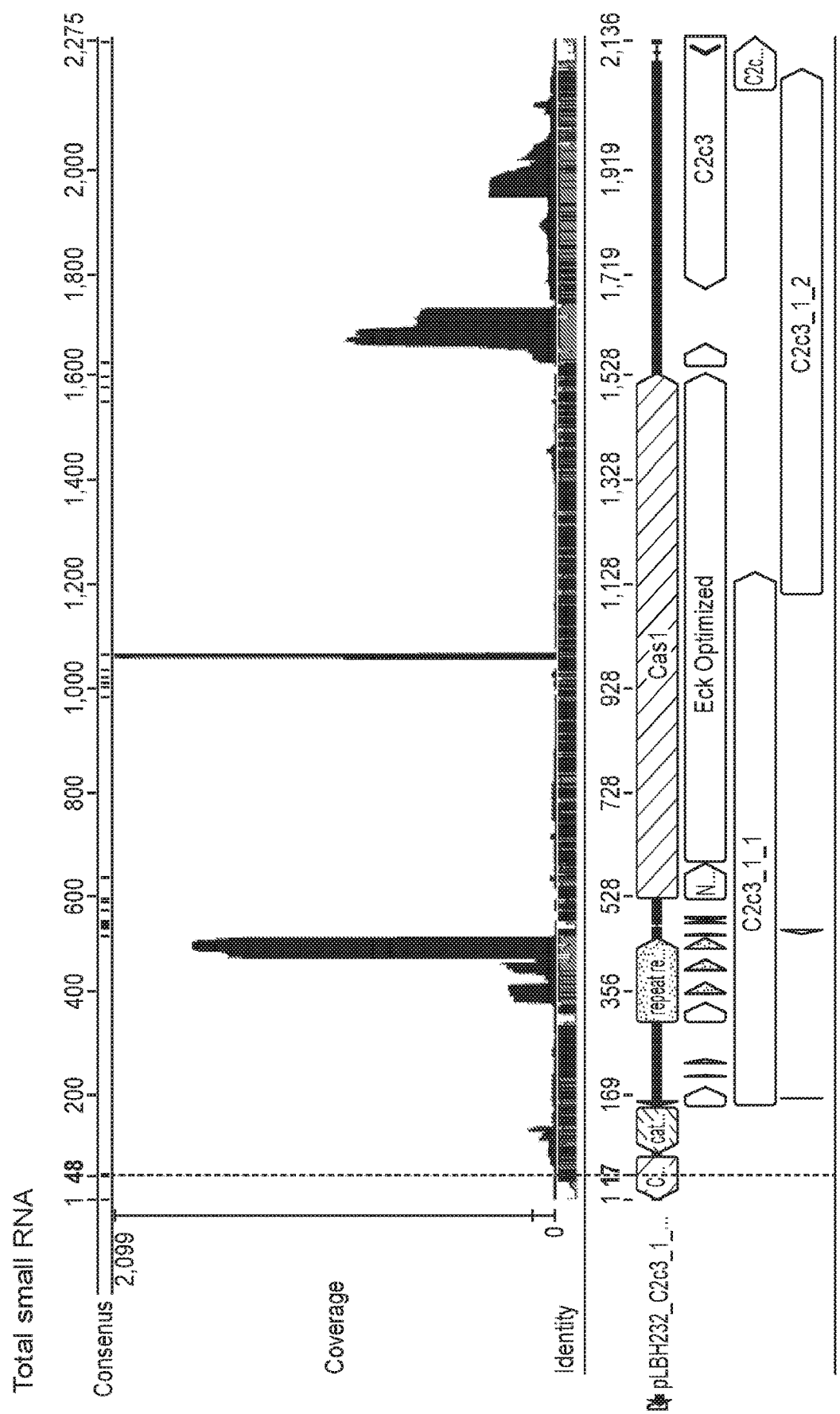
FIG. 3. depicts RNA mapping results from experiments showing the expression of trancRNA.
Figure 3:
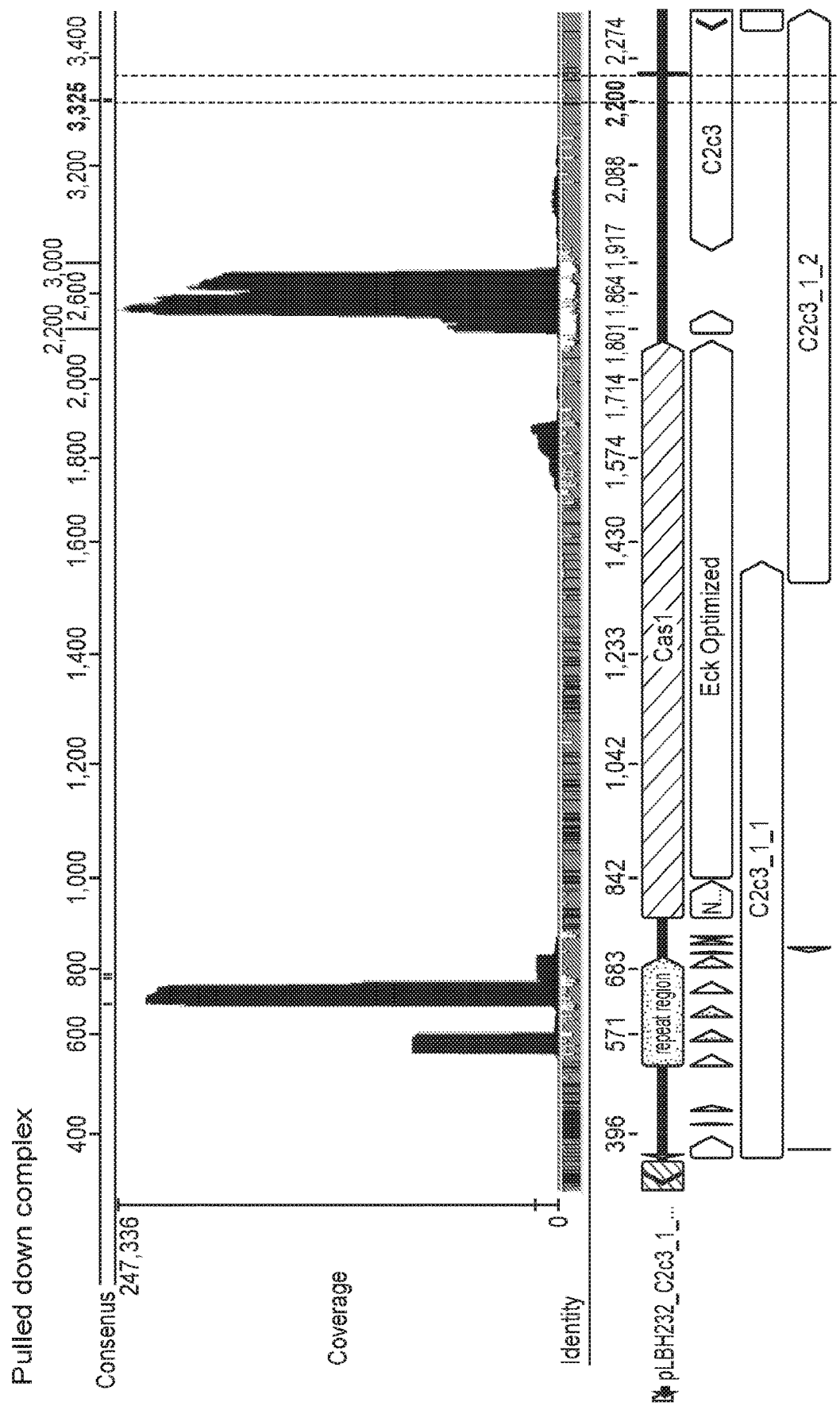

FIG. 3. The Cas12c CRISPR/Cas locus (for the Cas12c_1 protein) was transferred to and expressed in E. coli. Results from the RNA mapping of the Cas12c locus are presented (Top). In addition, the Cas12c protein was tagged and purified, and the RNA that was associated with the protein was sequenced, and results from the RNA mapping are presented (bottom). Both mapping results indicated the existence of a highly transcribed non-coding transcript adjacent to the Cas1-encoding sequence but on the opposite side of the Cas1-encoding sequence as the CRISPR array (Small repeating aligned arrows represent the repeats of the CRISPR array). The highly transcribed noncoding RNA is not complementary to the directed repeat as are transactivating CRISPR RNAs (tracrRNA). The transactivating non-coding RNA is referred herein as "trancRNA". The data show (see bottom) that trancRNA forms a complex with the Cas12c protein and its guide RNA.

Figure 4:
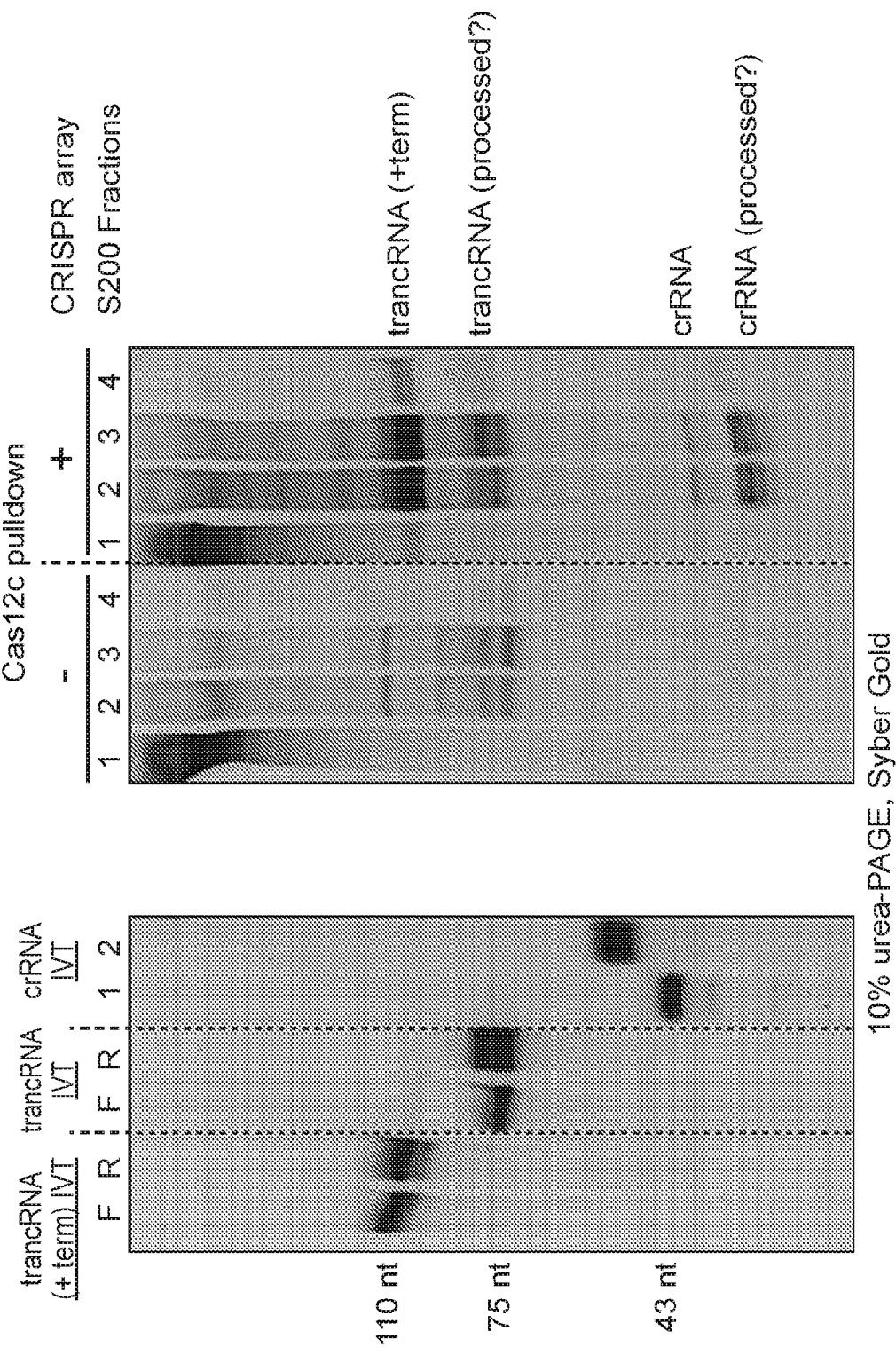
FIG. 4. depicts gels of RNAs that co-purified with Cas12c protein.

FIG. 4. RNAs that pulled down (co-purified) with the Cas12c protein were run on urea-PAGE gels, confirming the presence of guide RNA and trancRNA.

Figure 5:
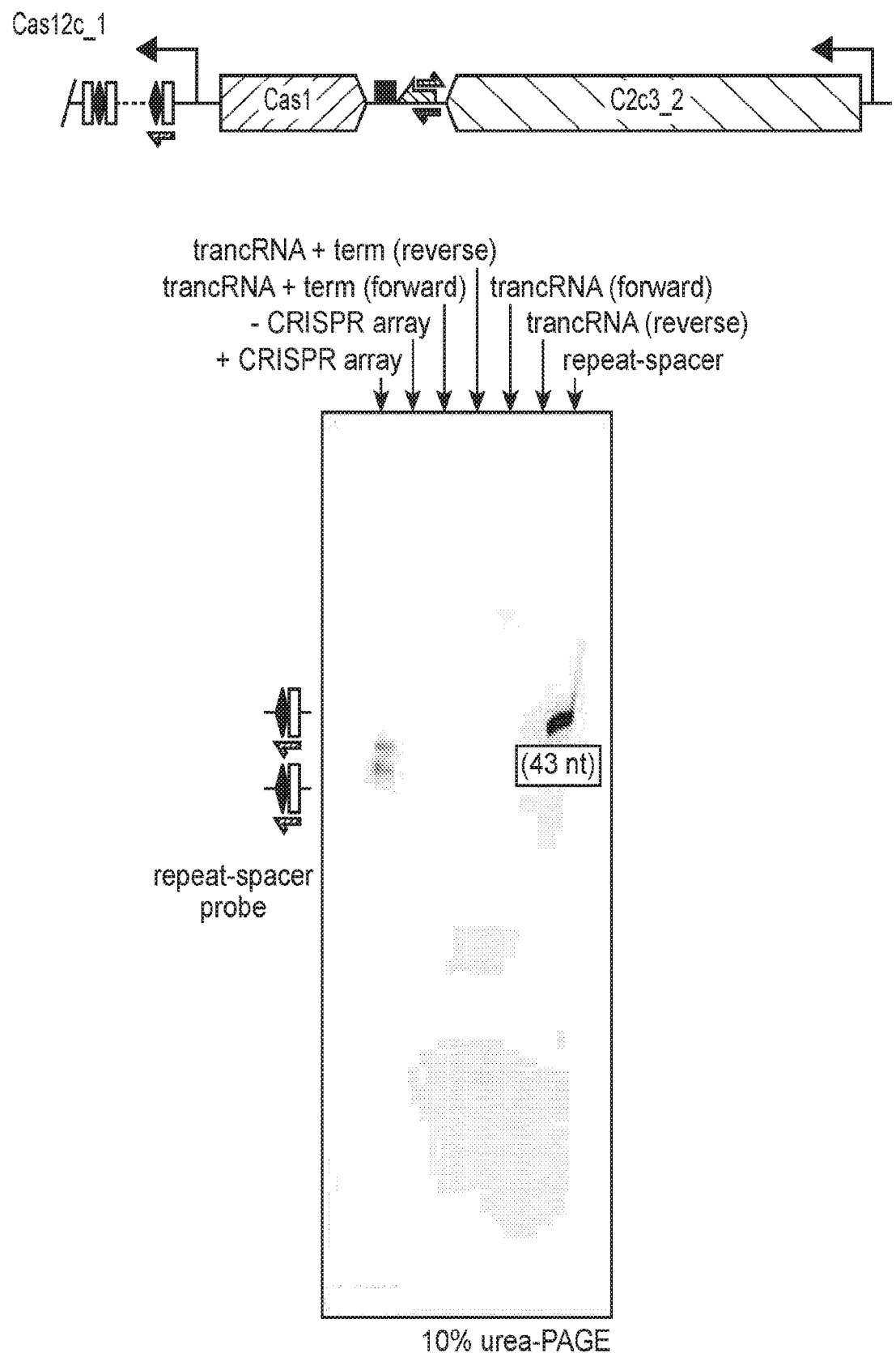
FIG. 5. depicts results from Northern blots confirming the expression of trancRNA from Cas12c loci.
Figure 5:
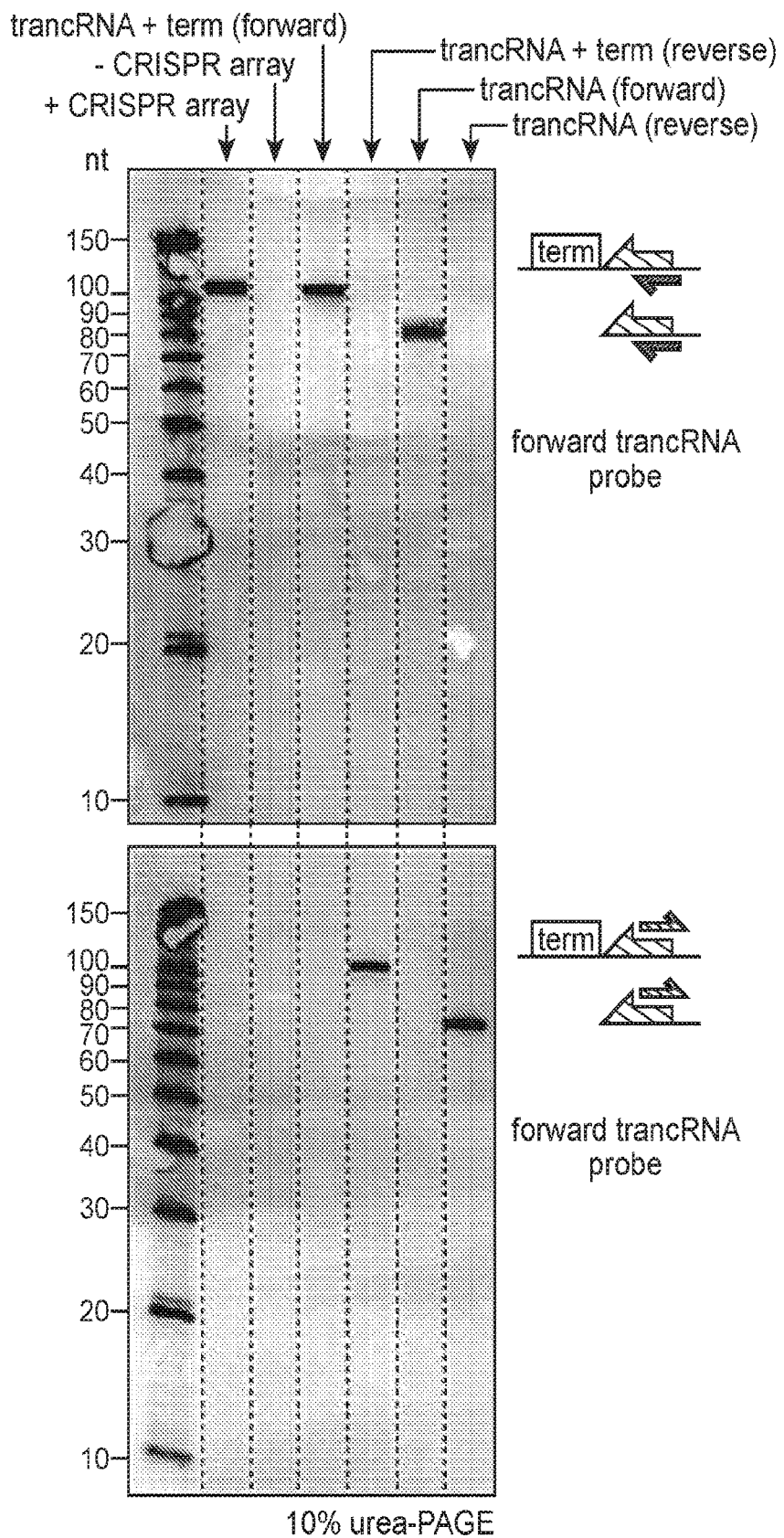

FIG. 5. Northern blots confirmed the expression of trancRNA from Cas12c loci (in this particular case when transferred into E. coli.).

Figure 6:
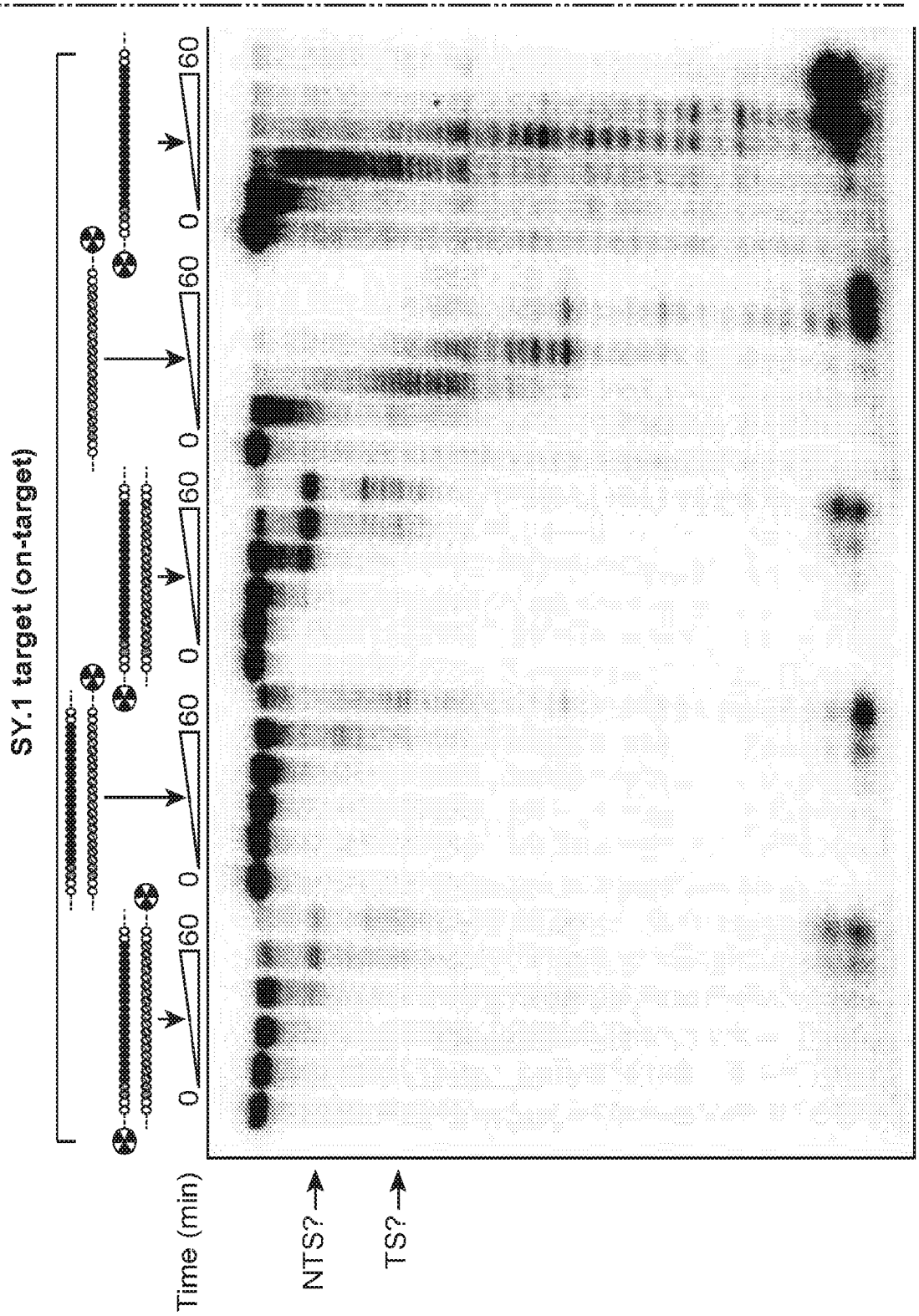
FIG. 6. depicts data from using the Cas12c pull-down complex (which included the Cas12c protein, trancRNA and guide RNA) was used to cleave dsDNA or ssDNA substrates. The shredding of the ssDNA was likely due to a contaminating exonuclease. However, there seems to be specific C2c3-mediated cleavage of the labeled non-target strand (NTS) (and perhaps also for the target strand (TS)), suggesting a staggered cleavage event.
Figure 6:
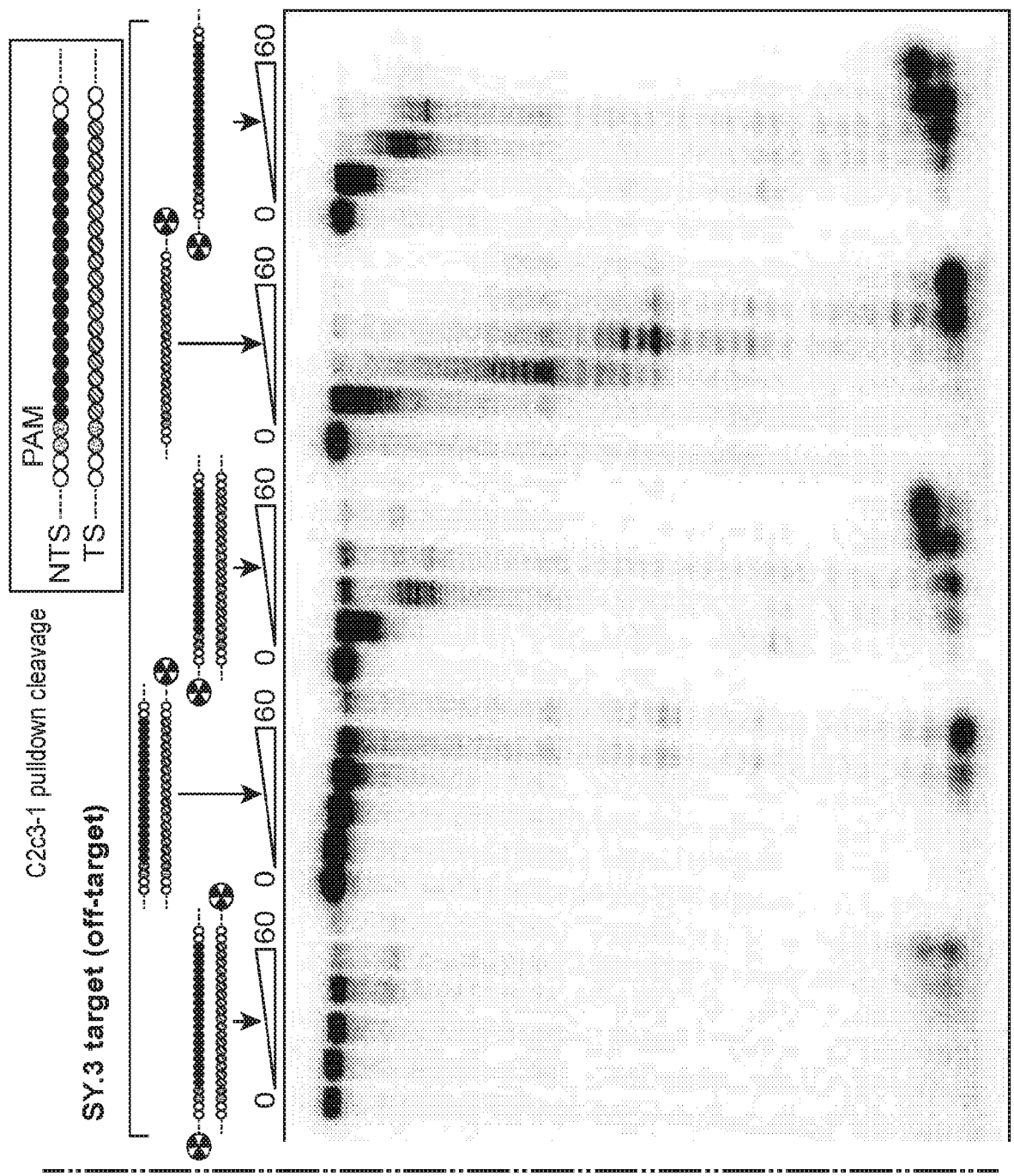

FIG. 6. the purified (pulled down) complex (which included the Cas12c protein, the guide RNA, and the trancRNA) was used to contact and cleave dsDNA or ssDNA substrates. The shredding of the ssDNA was likely due to a contaminating exonuclease. However, there seems to be specific C2c3-mediated cleavage of the labeled non-target strand (NTS) (and perhaps also for the target strand (TS)), suggesting a staggered cleavage event.

Example 2

The work described herein includes an analysis of metagenomic samples of microbial communities from groundwater, sediments, and acid mine drainage.

FIG. 9. CasY domains and similarity searches. (panel a) Schematic domain representation for CasY inferred from distant homolog alignments with AcCpf1, using HHpred. Conserved catalytic residues are marked by red bars above the proteins. CasY contains a RuvC split domain in the C-terminal region (RuvC-I, RuvC-II, and RuvC-III), and a large novel N-terminal domain Below the schematic are displayed top hits based on the following searches: (1) BLAST search against all the proteins in NCBI (NR database, including model and environmental proteins). (2) Profile hidden markov model (HMM) search based on models built using all the Cas proteins described in Makarova et al. Nat Rev Microbiol. 2015 November; 13(11):722-36, and Shmakov et al. Mol Cell. 2015 Nov. 5; 60(3):385-97). (3) Distant homolog search based on HHpred. Hits are color-coded based on their significance, and the hit range and E-value is provided. Notably, CasY had only local hits. The 812 N-terminal amino acid of CasY had only one very minor partial hit. Combined, these finding indicate CasY is a new Cas protein. (panel b) Different CasY-containing CRISPR loci scaffolds were constructed from sequence data.

Example 3

Figure 10:
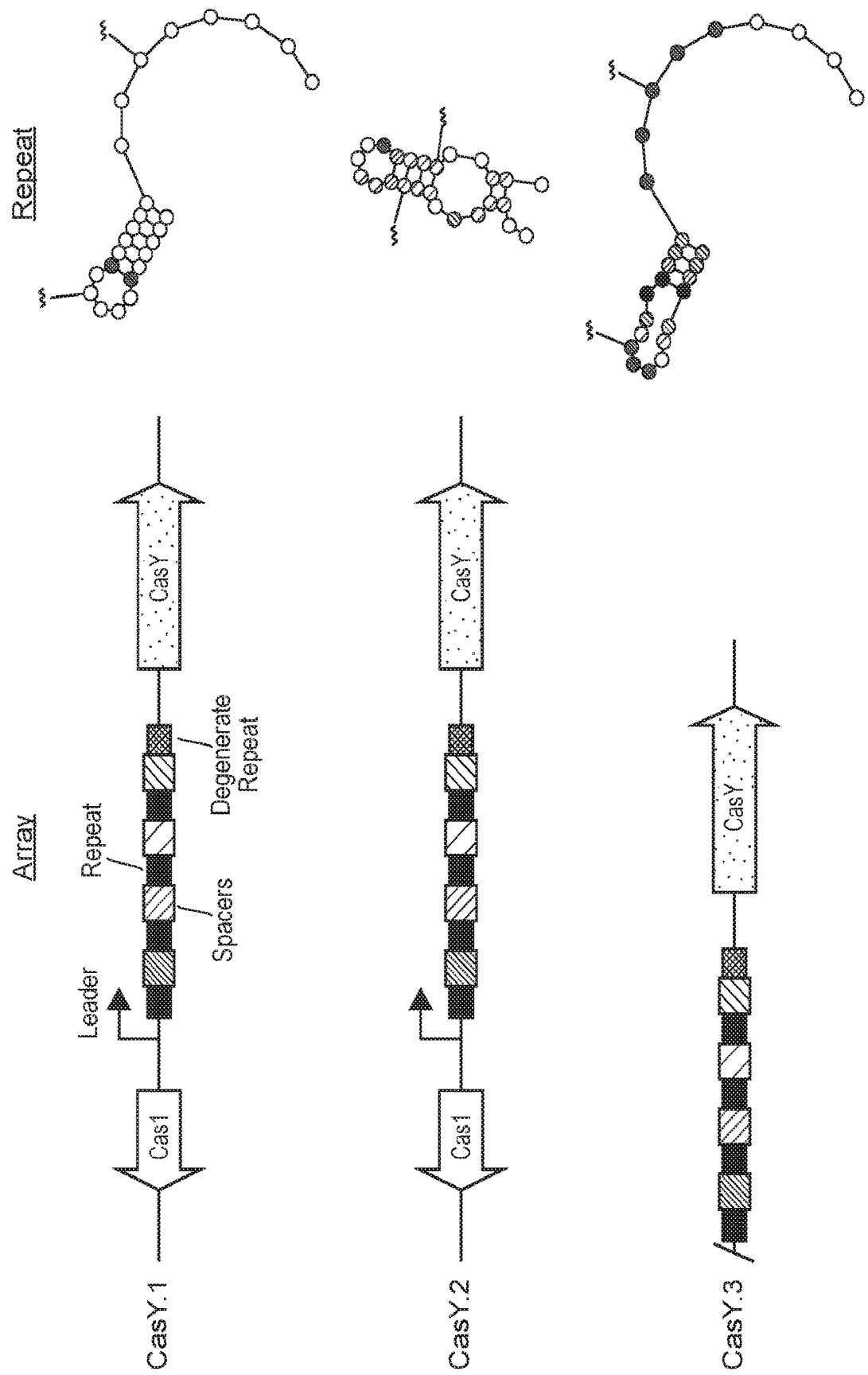
FIG. 10 depicts a schematic diagram of CasY and C2c3 loci. Interference proteins are shown in green, acquisition proteins in red. Repeats folded using RNA structure are shown to the right revealing a strong hairpin at the 5' end, suggesting self processing of the CRISPR array by CasY.
Figure 10:
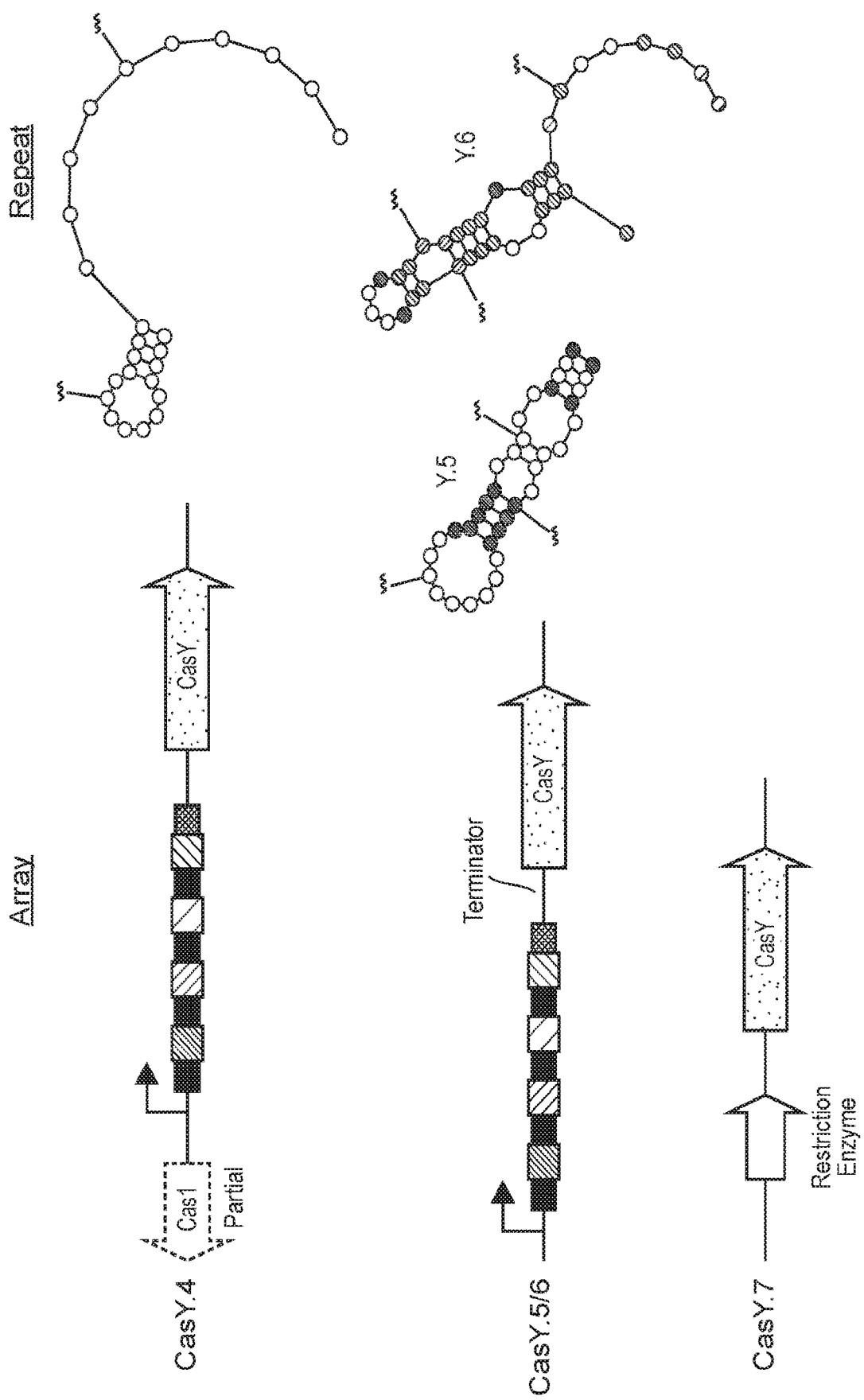
Figure 10:
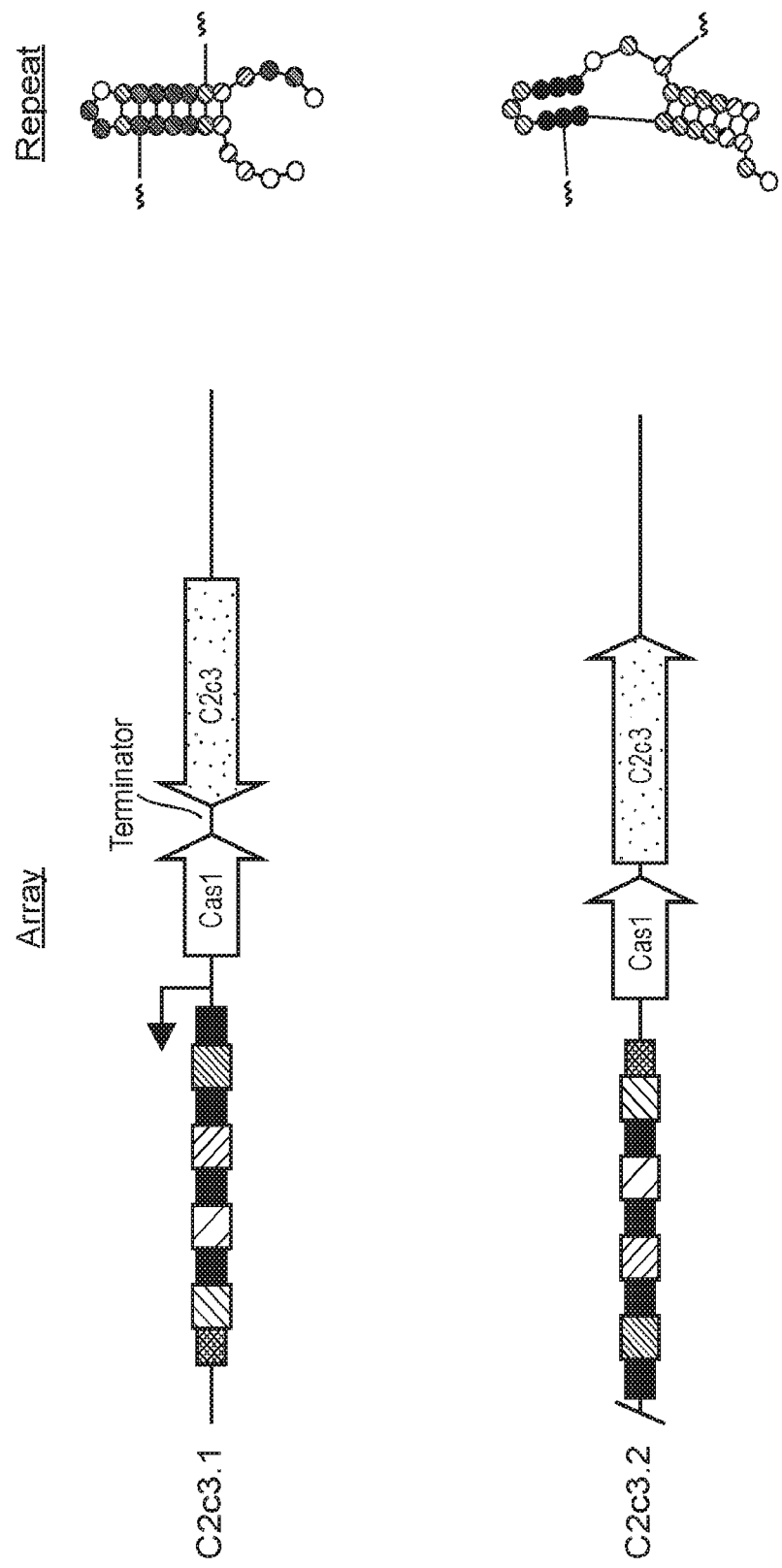

FIG. 10. Schematic diagram of Diagram of CasY and C2c3 loci. Interference proteins are shown in green, acquisition proteins in red. Repeats folded using RNA structure are shown to the right revealing a strong hairpin at the 5' end, suggesting self processing of the CRISPR array by CasY.

Figure 11:
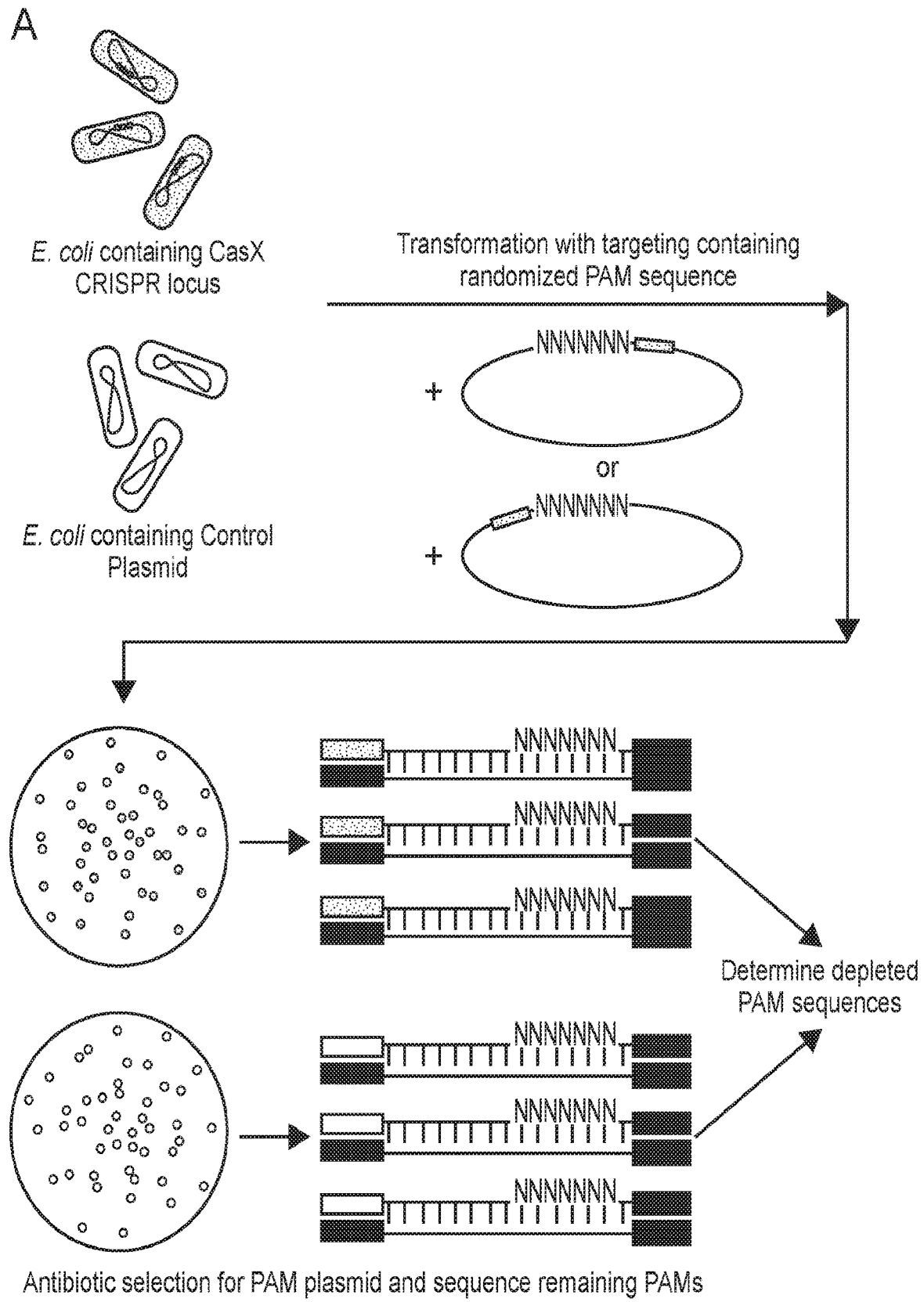
FIG. 11 (panels a-d) depicts experiments performed (PAM dependent plasmid interference) to determine a PAM sequence for Cas Y, as well as data that were aquired.
Figure 11:
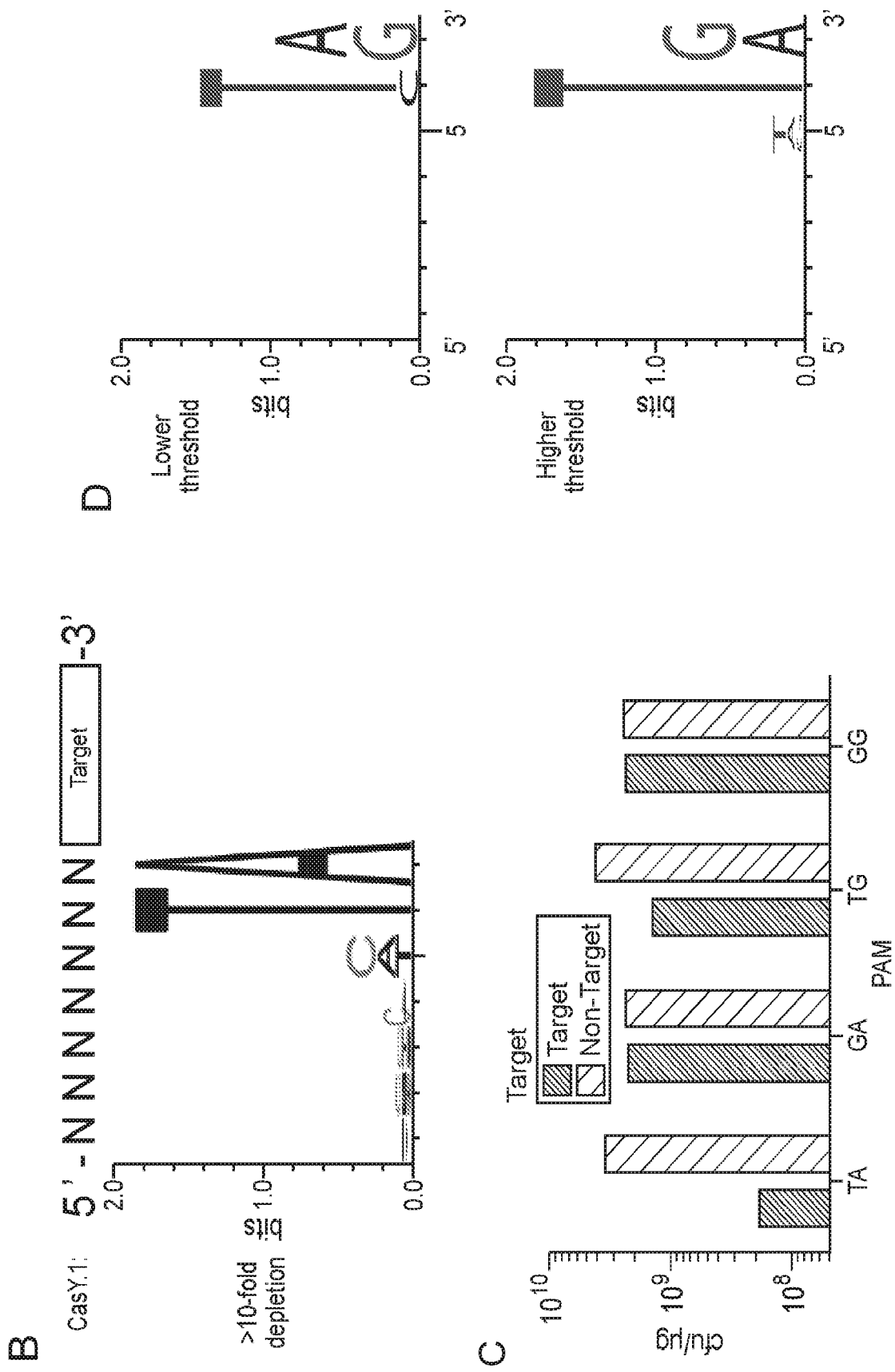
Figure 13:
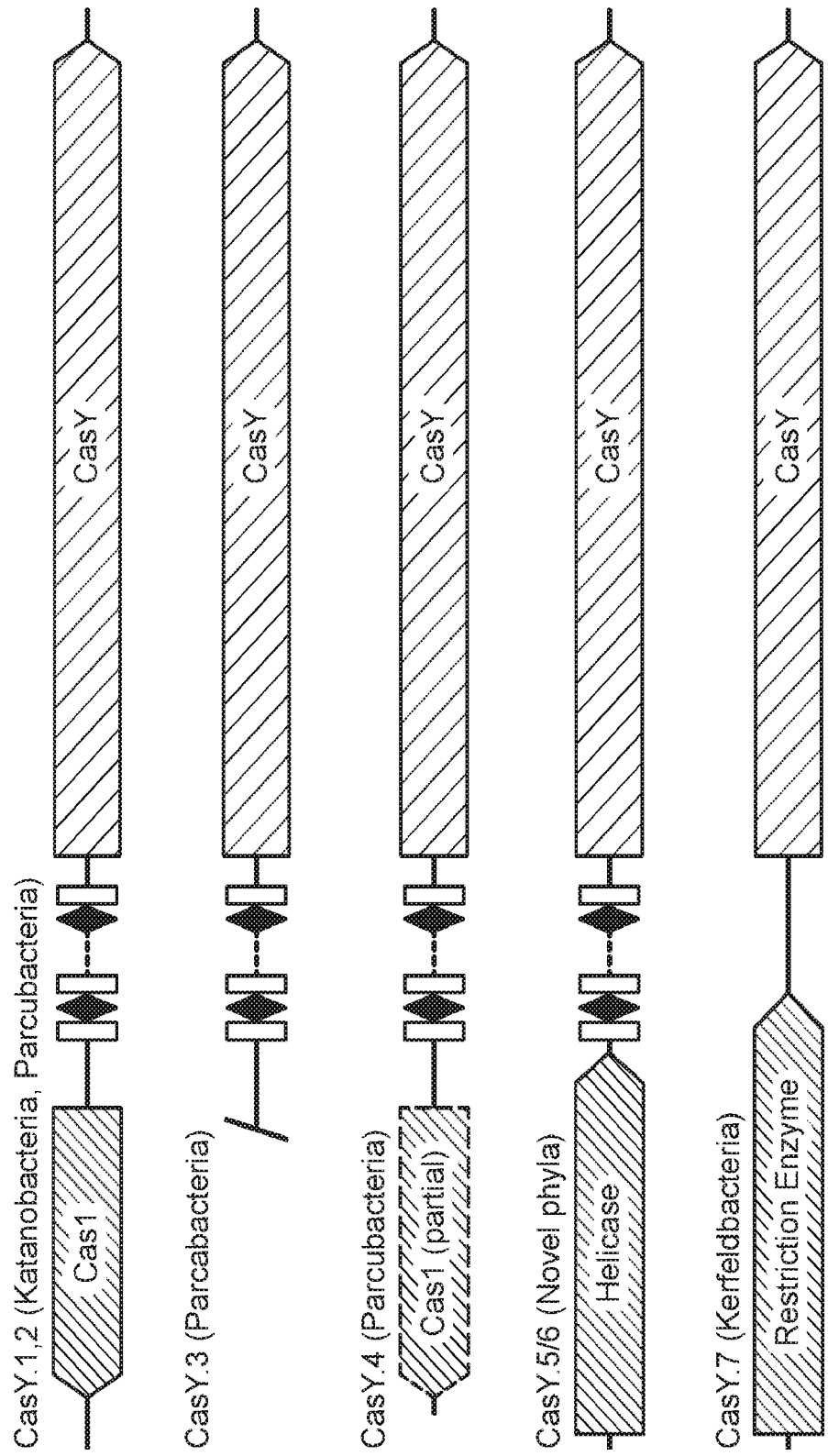
FIG. 13 (panels a-c) presents data showing expression of a CasY locus in *E. coli* is sufficient for DNA interference. (panel a) Diagrams of CasY loci and neighboring proteins. (panel b) WebLogo of 5' PAM sequences depleted greater than 3-fold by CasY relative to a control library. (panel c) Plasmid interference by *E. coli* expressing CasY.1 and transformed with targets containing the indicated PAM. Experiments were conducted in triplicate and mean±s.d is shown.

FIG. 11 (panels a-d) PAM dependent plasmid interference by CasY. (panel a) PAM depletion assays were conducted with CasY. E. coli containing the CasY CRISPR locus were transformed with a plasmid library with 7 nucleotides randomized 5' or 3' of the target sequence. The target plasmid was selected for and transformants were pooled. The randomized region was amplified and prepared for deep sequencing. Depleted sequences were identified and used to generate a PAM logo. (panel b) the generated PAM logo for CasY.1 showed a strong preference for sequences containing a 5'-TA-3' flanking sequence 5' of the target. A 3' PAM was not detected. (panel c) Four different PAMs were assayed directly to verify the PAM determined from the PAM depletion assay. (panel d) the generated PAM logos for CasY.2 showed a preference for sequences containing 5'-TA-3', 5'-YR-3' and/or 5'-TR-3' (e.g., 5'-DTR-3') (lower threshold and higher threshold, respectively) flanking sequence 5' of the target (where Y is a T or C; R is an A or G; and D is an A, G, or T). A 3' PAM was not detected.

FIG. 12. (panel a) 'repeat' sequences from naturally occurring CasY guide RNAs (For CasY loci Y1-Y6). (panel b) Diagram of CasY RNA guided DNA cleavage. CasY protein binds to a crRNA (the CasY guide RNA) in the repeat region (black, repeat; red, spacer). Base pairing of the guide sequence of the guide RNA to the target sequence (blue) containing the correct protospacer adjacent motif (PAM) results in double stranded cleavage of the target DNA. (panel c) examples of CasY trancRNAs.

FIG. 23. Plasmid interference assay containing a CRISPR loci plasmid of the present invention. 10 ng of target plasmid was transformed into electrocompetent E. coli (NEB Stable) containing the CRISPR loci plasmid. CasY15 was used for the plasmid interference assays under control of Tetracycline inducible promoter (Tet) or using a strong heterologous promoter (J23119) for sgRNA and crRNA expression. Cells were recovered for 2 h at 25° C. in super optimal broth and an appropriate dilution was plated on selective media. Plates were incubated at 25° C. and colony forming units were counted. All plasmid interference experiments were performed in triplicate and electrocompetent cells were prepared independently for each replicate. Plasmid pLBH682 included a single guide RNA and trancRNA was included in front of CasY15.

FIG. 24, Panels A-F PAM-dependent plasmid interference assays that show PAM depletion to determine a PAM sequence for CasY orthologs (FIG. 24, Panel A:CasY1, FIG. 24, Panel B:CasY15, FIG. 24, Panel C: CasY10, FIG. 24, Panel D: CasY3, FIG. 24, Panel E: CasY11; FIG. 24, Panel F: C2c3_1). Plasmid libraries containing randomized PAM sequences were assembled by annealing a DNA oligonucleotide containing a target with a 7-nucleotide randomized PAM region with a primer and extended with Klenow Fragment (NEB). The double-stranded DNA was digested with EcoRI and NcoI and ligated into a pUC19 backbone. The ligated library was transformed into E. coli DH5α and >10$^8$ cells were harvested and the plasmids extracted and purified. 200 ng of the pooled library was transformed into electrocompetent E. coli harboring a CRISPR locus or a control plasmid with no locus. The transformed cells were plated on selective medium containing carbeni-cillin (100 mg 1-1) and chloramphenicol (30 mg 1-1) for 30 h at 25° C. Plasmid DNA was extracted and the PAM sequence was amplified with adapters for Illumina sequencing. The 7-nucleotide PAM region was extracted and PAM frequencies calculated for each 7-nucleotide sequence. PAM sequences depleted above the specified threshold were used to generate a sequence logo with WebLogo.

FIG. 25, Panels A-F CasY15 trans cleavage assays with various RNA components, PAM sequences, and mismatch tolerance. 100 nM CasY was complexed with 125 nM crRNA, 125 nM tracrRNA and 50 nM FQ probe in 1× Cleavage Buffer at 37° C. for 10 min. The reaction was then initiated by addition of 2 nM ssDNA activator for all reactions except for the RNA optimization experiments, where the variable RNA component was used to initiate. The reaction was monitored in a fluorescence plate reader for up to 120 minutes at 37° C. with fluorescence measurements taken every 1 min (λex: 485 nm; λem: 535 nm). The resulting data were background-subtracted using the readings taken in the absence of activator and fit to obtain KObs. The F-Q 8nt sequence used is shown in Table 6. Higher fluorescence signal indicates increased cleavage activity.

Example 4: CasY4 trancRNA

RNA mapping to the CasY locus indicated the existence of a highly transcribed noncoding RNA between the CRISPR array and CasY4

Figure 14:
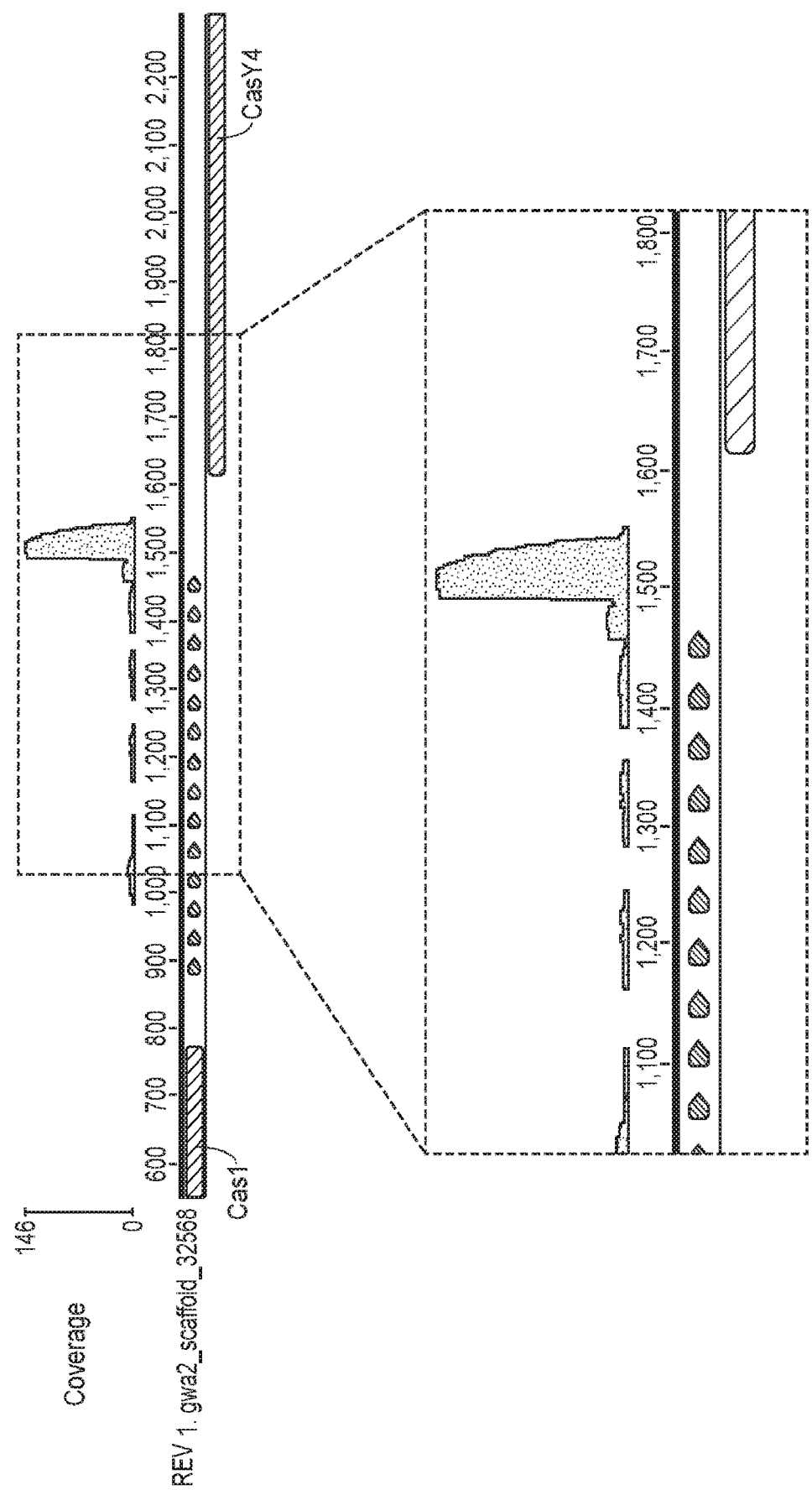
FIG. 14 presents data from environmental RNA mapping to the CasY4 locus. RNA sampled from the site in which CasY4 was found indicates the existence of a highly transcribed noncoding transcript between the CRISPR array and CasY4 Small arrows under the number-line represent the repeats of the CRISPR array; Cas1 (left) and CasY4 (right) denote the regions coding for the N' termini of these proteins; the bars above the number-line represent the coverage of RNA reads. The peak between 1,491 and 1541 represent a highly transcribed CasY4 trancRNA.

FIG. 14. Environmental RNA mapping to the CasY4 locus. RNA sampled from the site in which CasY4 was found indicates the existence of a highly transcribed noncoding transcript between the CRISPR array and CasY4. The highly transcribed noncoding RNA is not complementary to the directed repeat as are transactivating CRISPR RNAs (tracrRNA). The transactivating noncoding RNA is referred to as "trancRNA." The CasY4 trancRNA has the following nucleotide sequence: GGUAUUUCCGGACAGCGGCUUGACCGCAUCGUC-CUCGCCUUUUCCUAAAAU (SEQ ID NO: 247). Small arrows under the number-line represent the repeats of the CRISPR array; Cas1 (left) and CasY4 (right) denote the regions coding for the N' termini of these proteins; the bars above the number-line represent the coverage of RNA reads. The peak between 1,491 and 1541 represent a highly transcribed CasY4 trancRNA.

Figure 15:
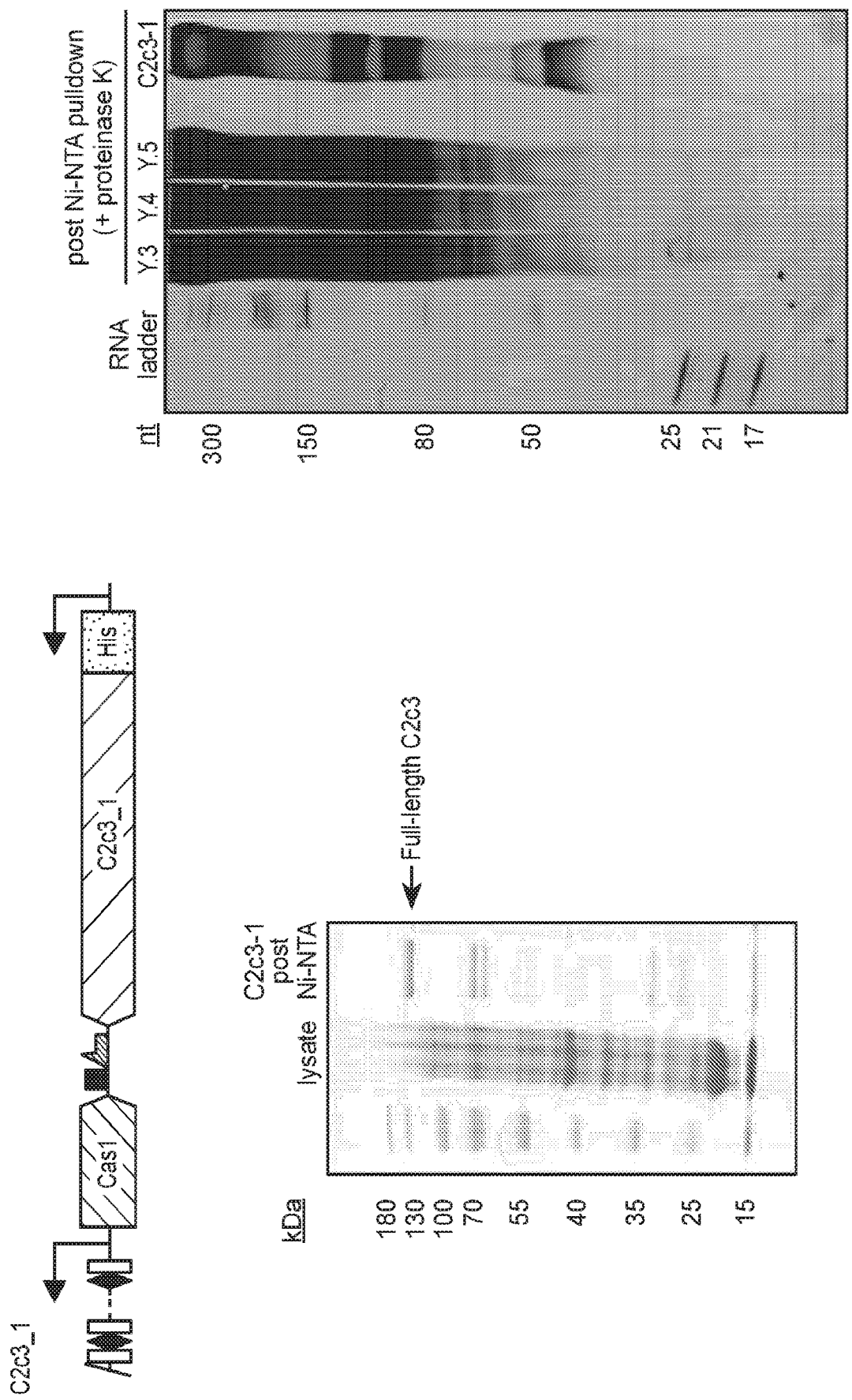
FIG. 15. depicts results from CasY pulldown experiments. A His tag was added to the N-terminus of CasY.3, CasY.4 and CasY.5 in the context of its native locus and the CasY complex was purified by Ni affinity purification. The CasYs seem to be getting degraded after the Ni column (C2c3 pulldown is included as a positive control), but the fragmented CasYs appear to be complexed with trancRNA.

FIG. 15. CasY pulldown experiments. A His tag was added to the N-terminus of CasY.3, CasY.4 and CasY.5 in the context of its native locus and the CasY complex was purified by Ni affinity purification. The CasYs seem to be getting degraded after the Ni column (C2c3 pulldown is included as a positive control), but the fragmented CasYs appear to be complexed with trancRNA.

FIG. 16. Data from CasY trancRNA deletion experiments. A construct that includes the CasY1 locus was transferred into E. coli, and a target plasmid DNA was introduced. Transformants were quantified. The data show that in the presence of CasY trancRNA (CasY1 trancRNA in this particular example), the target DNA was cleaved efficiently (few transformants). In the absence of CasY trancRNA (CasY1 trancRNA in this particular example), the target DNA was not cleaved efficiently (many transformants).

Example 5

Materials and Methods for CasZ

The following materials and methods generally apply to the results presented in the Examples described herein except where noted otherwise.

Metagenomics and Metatranscriptomics

The initial analysis was performed on previously assembled and binned metagenomes from two sites: the Rifle Integrated Field Research (IFRC) site, adjacent to the Colorado River near Rifle, Colorado and Crystal Geyser, a cold, $CO_2$-driven geyser on the Colorado Plateau in Utah. Metatranscriptomic data from IFRC site was used to detect transcription of non-coding elements in nature. Further mining of CRISPR-Cas14 systems was then performed on public metagenomes from IMG/M.

CRISPR-Cas Computation Analysis

The assembled contigs from the various samples were scanned with the HMMer suite for known Cas proteins using Hidden Markov Model (HMMs) profiles. Additional HMMs were constructed for Cas14 proteins based on the MAFFT alignments of putative type V effectors that contained less than 800 aa, and were adjacent to acquisition cas genes and CRISPR arrays. These HMMs were iteratively refined by augmenting them with manually selected novel putative Cas14 sequences that were found using the existing Cas14 HMM models. The sequence of Cas14 repeat sequences are provided in Table 3. CRISPR arrays were identified using a local version of the CrisprFinder software and CRISPRDetect. Phylogenetic trees of Cas1 and type V effector proteins were constructed using RAxML with PROTGAMMALG as the substitution model and 100 bootstrap samplings. Trees were visualized using FigTree 1.4.1 (http://tree.bio.ed.ac.uk/ software/figtree/). Metatranscriptomic reads were mapped to assembled contigs using Bowtie2. RNase presence analysis was based on HMMs that were built from alignment of KEGG orthologous groups (KOs) downloaded from KEGG database.

TABLE 5

Repeat sequences (non-guide sequence portion of a Cas14 guide RNA) of all Cas14 proteins used herein (e.g., see FIG. 29) are shown in Table 5.

| Cas14 Protein | Repeat sequence | SEQ ID NO: | Scaffold Accession No: |
|---|---|---|---|
| Cas14a.1 (CasZa.3) | GTTGCAGAACCCGAATAGACGAATGAAGGAATGCAAC | 198 | NCBI: MK005734 |
| Cas14a.2 (Za.8) | CTTGCAGAACCCGGATAGACGAATGAAGGAATGCAAC | 368 | NCBI: MK005733 |
| Cas14a.3 (CasZa.3) | GTTGCAGAACCCGAATAGACGAATGAAGGAATGCAAC | 198 | NCBI: MK005732 |
| Cas14a.4 (CasZa.4) | CTATCATATTCAGAACAAAGGGATTAAGGAATGCAAC | 199 | NCBI: MK005735 |
| Cas14a.5 (CasZa.5, CasZb.3) | CTTTCATACTCAGAACAAAGGGATTAAGGAATGCAAC | 200 | NCBI: MK005736 |
| Cas14a.6 (CasZa.6) | GTCTACAACTCATTGATAGAAATCAATGAGTTAGACA | 201 | IMG/M: Ga0137385_10000156 |
| Cas14b.1 (Cas Zb.2) | GTTGCAGAAATAGAATAAAGGAATTAAGGAATGCAAC | 204 | NCBI: MK005737 |
| Cas14b.2 (CasZa.5, CasZb.3) | CTTTCATACTCAGAACAAAGGGATTAAGGAATGCAAC | 200 | NCBI: MK005738 |
| Cas14b.3 (CasZb.4) | ATTTCATACTCAGAACAAAGGGATTAAGGAATGCAAC | 206 | NCBI: MK005739 |
| Cas14b.4 (CasZb.16) | GTTTCAGCGCACGAATTAACGAGATGAGAGATGCAAC | 377 | NCBI: MK005740 |
| Cas14b.5 (CasZb.6) | CTTGCAGAAGCTGAATAGACGAATCAAGGAATGCAAC | 208 | NCBI: MK005741 |
| Cas14b.6 (Za.12) | CTTGCAGGCCTTGAATAGAGGAGTTAAGGAATGCAAC | 370 | NCBI: MK005742 |
| Cas14b.7 (CasZb.9) | GTTGCAGCGCCCGAACTGACGAGACGAGAGATGCAAC | 211 | IMG/M: Ga0172369_10000737 |
| Cas14b.8 (CasZb.10) | GTTGCGCGAATAGAATAAAGGAATTAAGGAATGCAAC | 212 | IMG/M: Ga0172369_10010464 |
| Cas14b.9 (CasZb.11) | AGTTGCATTCCTTAATCCCTCTGTTCAGTTTGTGCAAT | 213 | IMG/M: Ga0172365_10004421 |
| Cas14b.10 (Zb.13) | GTTGCACAGTGCTAATTAGAGAAACTAGGAATGCAAC | 371 | NCBI: MK005743 |
| Cas14b.11 (CasZc.2) | GTTGCGGCGCGCGAATAAACGAGACTAGGAATGCAAC | 215 | NCBI: MK005744 |
| Cas14b.12 (Zb.14) | CTAGCATATTCAGAACAAAGGGATTAAGGAATGCAAC | 372 | NCBI: MK005745 |
| Cas14b.13 (CasZc.4) | CTTTCATATTCAGAACAAAGGGATTAAGGAATGCAAC | 217 | NCBI: MK005746 |

TABLE 5-continued

Repeat sequences (non-guide sequence portion of a Cas14 guide RNA) of all Cas14 proteins used herein (e.g., see FIG. 29) are shown in Table 5.

| Cas14 Protein | Repeat sequence | SEQ ID NO: | Scaffold Accession No: |
|---|---|---|---|
| Cas14b.14 (Zb.15) | CTTTCATATTCAGAAACTAGGGGTTAAGGACTGCAAC | 373 | NCBI: MK005747 |
| Cas14b.15 (CasZc.6) | GTTGCAGCCCCCGAACTAACGAGATGAGAGATGCAAC | 219 | IMG/M: Ga0116204_1008574 |
| Cas14b.16 (casZc.7) | CTTGCAGAACAATCATATATGACTAATCAGACTGCAAC | 220 | IMG/M: Ga0078972_1001015a |
| Cas14c.1 (Zb.8) | GTTGCATCCCTACGTCGTGAGCACCGGTGAGTGCAAC | 374 | NCBI: MK005748 |
| Cas14c.2 (CasZd.2) | GTCCCTACTCGCTAGGGAAACTAATTGAATGGAAAC | 222 | IMG/M: JGI12048J13642_10201286 |
| Cas14d.1 (CasZe.2) | CTTCCAAACTCGAGCCAGTGGGGAGAGAAGTGGCA | 224 | NCBI: MK005750 |
| Cas14d.2 (CasZe.3) | CCTGTAGACCGGTCTCATTCTGAGAGGGGTATGCAACT | 225 | NCBI: MK005751 |
| Cas14d.3 (CasZe.4) | GTCTCGAGACCCTACAGATTTTGGAGAGGGGTGGGAC | 226 | NCBI: MK005752 |
| Cas14e.1 (CasZf.1) | GTAGCAGGACTCTCCTCGAGAGAAACAGGGGTATGCT | 228 | NCBI: MK005753 |
| Cas14e.2 (CasZf.2) | GTACAATACCTCTCCTTTAAGAGAGGGAGGGGTACGCTAC | 229 | NCBI: MK005754 |
| Cas14e.3 (Zc.5) | GGAAAGGAATCCCCTGAAGGAAACGAGGGGG | 375 | NCBI: MK005755 |
| Cas14f.1 (CasZg.1) | GGTTCCCCCGGGCGCGGGTGGGGTGGCG | 231 | NCBI: MK005756 |
| Cas14f.2 (CasZg.2) | GGCTGCTCCGGGTGCGCGTGGAGCGAGG | 232 | IMG/M: Ga0105042_100140 |
| Cas14g.1 (Ze.3) | GTGTCCATCAATCAGATTTGCGTTGGCCGGTGCAAT | 376 | NCBI: MK005758 |
| Cas14g.2 (CasZi.2) | GCCGCAGCGGCCGACGCGGCCCTGATCGATGGACAC | 235 | IMG/M: Ga0123330_1010394 |
| Cas14h.1 (CasZk.1) | GGCTAGCCCGTGCGCGCAGGGACGAGTGG | 237 | IMG/M: Ga0070762_10001740 |
| Cas14h.2 (CasZk.2) | GCCCGTGCGCGCAGGGACGAGTGG | 238 | IMG/M: Ga0070766_10011912 |
| Cas14h.3 (CasZk.4) | CCATCGCCCCGCGCGCACGTGGATGAGCC | 240 | IMG/M: Ga0116216_10000905 |
| Cas14u.1 (CasZa.7) | GTTATAAAGGCGGGGATCGCGACCGAGCGATTGAAAG | 202 | IMG/M: Ga0066793_10010091 |
| Cas14u.2 (CasZb.8) | GTCTCCATGACTGAAAAGTCGTGGCCGAATTGAAAC | 210 | IMG/M: JGI24730J26740_1002785 |

TABLE 5-continued

Repeat sequences (non-guide sequence portion of a Cas14 guide RNA) of all Cas14 proteins used herein (e.g., see FIG. 29) are shown in Table 5.

| Cas14 Protein | Repeat sequence | SEQ ID NO: | Scaffold Accession No: |
|---|---|---|---|
| Cas14u.3 (CasZe.1) | GTTGCATTCGGGTGCAAAACAGGGAGTAGAGTGTAAC | 223 | NCBI: MK005749 |
| Cas14u.4 (CasZj.2) | CTTTTAGACAGTTTAAATTCTAAAGGGTATAAAAC | 378 | NCBI: MK005757 |
| Cas14u.5 (CasZj.1) | GTCGAAATGCCCGCGCGGGGCGTCGTACCCGCGAC | 236 | IMG/M: Ga0137373_10000316 |
| Cas14u.6 (CasZk.3) | GTTGCAGCGGCCGACGGAGCGCGAGCGTGGATGCCAC | 239 | IMG/M: Ga0070717_10000077 |
| Cas14u.7 (CasZl.1) | CTTTAGACTTCTCCGGAAGTCGAATTAATGGAAAC | 241 | IMG/M: JGI12210 IMG/M: J13797_10004690 |
| Cas14u.8 (CasZl.2) | GGGCGCCCCGCGCGAGCGGGGTTGAAG | 242 | IMG/M: Ga0073904_10021651 |

Generation of Expression Plasmids, RNA and DNA Substrates

Minimal CRISPR loci for putative systems were designed by removing acquisition proteins and generating minimal arrays with a single spacer. These minimal loci were ordered as gBlocks (IDT) and assembled into a plasmid with a tetracycline inducible promoter driving expression of the locus. Plasmid maps were available on Addgene and in the figures. All RNA was in vitro transcribed using T7 polymerase and PCR products as dsDNA template. Resulting IVTs were gel extracted and ethanol precipitated. DNA substrates were obtained from IDT and their sequences are available in Table 4. For radiolabeled cleavage assays DNA oligos were gel extracted from a PAGE gel before radiolabeling. For FQ assays, DNA substrates were used without further purification.

E. coli RNAseq

Small RNA sequencing was conducted as described previously with modification in Harrington et al. (2017). E. coli NEB Stable3 was transformed with a plasmid expressing Cas14a1 system with a tetracycline inducible promoter upstream of the Cas14a1 ORF or the same plasmid with an N-terminal 10×-histidine tag fused to Cas14. Starters were grown up overnight in SOB, diluted 1:100 in 5 mL fresh SOB containing 214 nM anhydrotetracycline and grown up overnight at 25° C. For sequencing of RNA pulled down with Cas14a, the plasmid containing an N-terminal His-tag fused to Cas14a1 was grown up at 18° C. before lysis and purification as described in "Protein purification", stopping after the Ni-NTA elution. Cells were pelleted and RNA was extracted using hot phenol as previously described. Total nucleic acids were treated with TURBO DNase and phenol extracted. The resulting RNA was treated with rSAP which was heat inactivated before addition of T4 PNK. Adapters were ligated onto the small RNA using the NEBnext small RNA kit and gel-extracted on an 8% native PAGE gel. RNA was sequenced on a MiSeq with single end 300 bp reads. For analysis, the resulting reads were trimmed using Cutadapt, discarding sequences <8nt and mapped to the plasmid reference using Bowtie2.

PAM Depletion Assays

PAM depletion assays were conducted as previously described in Burstein et al. (2017). Randomized plasmid libraries were generated using a primer containing a randomized PAM region adjacent to the target sequence. The randomized primers were hybridized with a primer that was complementary to the 3' end of the primer and the duplex was extended using Klenow Fragment (NEB). The dsDNA containing the target and were digested with EcoRI and NcoI, ligated into pUC19 backbone and transformed into E. coli DH5α and >107 cells were harvested. Next E. coli NEBstable was transformed with either a CRISPR plasmid or an empty vector control and these transformed E. coli were made electrocompetent by repeated washing with 10% glycerol. These electrocompetent cells were transformed with 200 ng of the target library and plated on bioassay dishes containing selection for the target (carbenicillin, 100 mg 1-1) and CRISPR plasmid (chloramphenicol, 30 mg 1-1). Cells were harvested and prepared for amplicon sequencing on an Illumina MiSeq. The PAM region was extracted using Cutadapt and depletion values were calculated in python. PAMs were visualized using WebLogo.

Transcriptomic RNA Mapping

RNA was extracted from 0.2 mm filters using the Invitrogen TRIzol reagent, followed by genomic DNA removal and cleaning using the Qiagen RNase-Free DNase Set kit and the Qiagen Mini RNeasy kit. An Agilent 2100 Bioanalyzer (Agilent Technologies) was used to assess the integrity of the RNA samples. The Applied Biosystems SOLiD Total RNA-Seq kit was used to generate the cDNA template library. The SOLiD EZ Bead system (Life Technologies) was used to perform emulsion clonal bead amplification to generate bead templates for SOLiD platform sequencing. Samples were sequenced at Pacific Northwest National Laboratory on the 5500XL SOLID platform. The 50 bp single reads were trimmed using Sickle as in Brown et al. (2015).

Protein Purification

Cas14a1 was purified as described previously with modification. *E. coli* BL21(DE3) RIL were transformed with 10×His-MBP-Cas14a1 expression plasmid and grown up to OD600=0.5 in Terrific Broth (TB) and induced with 0.5 mM IPTG. Cells were grown overnight at 18° C., collected by centrifugation, resuspended in Lysis Buffer (50 mM Tris-HCl, pH 7.5, 20 mM imidazole, 0.5 mM TCEP, 500 mM NaCl) and broken by sonication. Lysate was batch loaded on to Ni-NTA resin, washed with the above buffer before elution with Elution Buffer (50 mM Tris-HCl, pH 7.5, 300 mM imidazole, 0.5 mM TCEP, 500 mM NaCl). The MBP and His-tag were removed by overnight incubation with TEV at 4° C. The resulting protein exchanged into Buffer A (20 mM HEPES, pH 7.5, 0.5 mM TCEP, 150 mM NaCl) and loaded over tandem MBP, heparin columns (GE, Hi-Trap) and eluted with a linear gradient from Buffer A to Buffer B (20 mM HEPES, pH 7.5, 0.5 mM TCEP, 1250 mM NaCl). The resulting fractions containing Cas14a1 were loaded onto an 5200 gel filtration column, flash frozen and stored at −80° C. until use.

In Vitro Cleavage Assays

Radiolabeled

Radiolabeled cleavage assays were conducted in 1× Cleavage Buffer (25 mM NaCl, 20 mM HEPES, pH 7.5, 1 mM DTT, 5% glycerol). 100 nM Cas14a1 was complexed with 125 nM crRNA and 125 nM tracrRNA for 10 min at RT. ~1 nM radiolabeled DNA or RNA substrate was added and allowed to react for 30 min at 37° C. The reaction was stopped by adding 2× Quench Buffer (90% formamide, 25 mM EDTA and trace bromophenol blue), heated to 95° C. for 2 min and run on a 10% polyacrylamide gel containing 7M Urea and 0.5×TBE. Products were visualized by phosphorimaging.

M13 DIVA Cleavage

M13 DNA cleavage assays were conducted in 100 mM NaCl, 20 mM HEPES, pH 7.5, 1 mM DTT, 5% glycerol. 250 nM Cas14a1 was complexed with 250 nM crRNA and 250 nM tracrRNA and 250 nM ssDNA activator. The reaction was initiated by addition of 5 nM M13 ssDNA plasmid and was quenched by addition of loading buffer supplemented with 10 mM EDTA. Products were separated on a 1.5% agarose TAE gel prestained with SYBR gold (Thermofisher).

FQ Detection of Trans-Cleavage

FQ detection was conducted as previously described in Chen et al. (2018) with modification. 100 nM Cas14a1 was complexed with 125 nM crRNA, 125 nM tracrRNA, 50 nM FQ probe and 2 nM ssDNA activator in 1×Cleavage Buffer at 37° C. for 10 min. The reaction was then initiated by addition of activator DNA when for all reactions except for the RNA optimization experiments where the variable RNA component was used to initiate. The reaction was monitored in a fluorescence plate reader for up to 120 minutes at 37° C. with fluorescence measurements taken every 1 min ($\lambda$ex: 485 nm; $\lambda$em: 535 nm). The resulting data were background subtracted using the readings taken in the absence of activator and fit using a single exponential decay curve.

Data Availability

Plasmids used herein are available on Addgene (plasmid numbers 112500, 112501, 112502, 112503, 112504, 112505, 112506). Oligonucleotides used herein are provided in Table 4 and Table 5. The plasmids used herein are provided in FIG. 24. The Cas14 protein sequences used herein are provided in FIG. 7.

TABLE 6

Oligonucleotides and plasmids used herein.

| DNA Name | Sequence | SEQ ID NO: |
|---|---|---|
| Radiolabeld DNA activator 1 T strand | cTACGCCGattatcttctgacaactttcgcaagcggtgtaaggtaAAAAAtgCGGGCAC | 369 |
| Radiolabeld DNA activator 1 NT strand | GTGCCCGcaTTTTTtaccttacaccgcttgcgaaagttgtcagaagataatCGGCGTAg | 379 |
| Radiolabeld DNA activator 2 T strand | tttatatgtttctcctggagataacgcaatcgtgacaactttcgcaagcggtgtaaggtaGCAGGCTTCcgaattccgcgttttttacggc | 380 |
| Radiolabeld DNA activator 2 NT strand | gccgtaaaaacgcggaattcgGAAGCCTGCtaccttacaccgcttgcgaaagttgtcacgattgcgttatctccaggagaaacatataaa | 381 |
| Radiolabeld Activator 3 | gatcttcagcTATACATTATTGCACCAACACTAAGGCAGAGTATGtttacctggac | 382 |
| Radiolabeld Activator 4 | gatcttcagcTTTGTATTACTGGAAGGATGCTTGCTTGAGGTGTAaaaacctggac | 383 |
| F-Q 5 nt | /56-FAM/TTTTT/3IABkFQ/ | 384 |
| F-Q 6 nt | /56-FAM/TTTTTT/3IABKFQ/ | 385 |
| F-Q 7 nt | /56-FAM/TTTTTTT/3IABkFQ/ | 386 |

TABLE 6-continued

Oligonucleotides and plasmids used herein.

| DNA Name | Sequence | SEQ ID NO: |
|---|---|---|
| F-Q 8 nt | /56-FAM/TTTTTTTT/3IABKFQ/ | 387 |
| F-Q 9 nt | /56-FAM/TTTTTTTTT/3IABKFQ/ | 388 |
| F-Q 10 nt | /56-FAM/TTTTTTTTTT/3IABKFQ/ | 389 |
| F-Q 11 nt | /56-FAM/TTTTTTTTTTT/3IABKFQ/ | 390 |
| F-Q 12 nt | /56-FAM/TTTTTTTTTTTT/3IABKFQ/ | 391 |
| F-Q 10 nt A/T | /56-FAM/TATATATATA/3IABKFQ/ | 501 |
| F-Q 6 nt A/T | /56-FAM/TATATA/3IABKFQ/ | 502 |
| F-Q 5 nt A/T | /56-FAM/TATAT/3IABKFQ/ | 503 |
| Target 2, Perfect AAAT 3' | GCCGGGGTGGTGCCCATCCTGGTCGAGCTGGACGGCGACGTAAACGGCCACAAGC | 392 |
| Target 2, Perfect TCGT 3' | GCCGGGGTGGTGCCCATCCTGGTCGAGCTGGACGGCGACGTGCTCGGCCACAAGC | 393 |
| Target 2, 1-2 MM | GCCGGGGTGGTGCCCATCCTGGTCGAGCTGGACGGCGAGCTAAACGGCCACAAGC | 394 |
| Target 2, 3-4 MM | GCCGGGGTGGTGCCCATCCTGGTCGAGCTGGACGGCCTCGTAAACGGCCACAAGC | 395 |
| Target 2, 5-6 MM | GCCGGGGTGGTGCCCATCCTGGTCGAGCTGGACGCGGACGTAAACGGCCACAAGC | 396 |
| Target 2, 7-8 MM | GCCGGGGTGGTGCCCATCCTGGTCGAGCTGGAGCGCGACGTAAACGGCCACAAGC | 397 |
| Target 2, 9-10 MM | GCCGGGGTGGTGCCCATCCTGGTCGAGCTGCTCGGCGACGTAAACGGCCACAAGC | 398 |
| Target 2, 11-12 MM | GCCGGGGTGGTGCCCATCCTGGTCGAGCACGACGGCGACGTAAACGGCCACAAGC | 399 |
| Target 2, 13-14 MM | GCCGGGGTGGTGCCCATCCTGGTCGACGTGGACGGCGACGTAAACGGCCACAAGC | 400 |
| Target 2, 15-16 MM | GCCGGGGTGGTGCCCATCCTGGTCCTGCTGGACGGCGACGTAAACGGCCACAAGC | 401 |
| Target 2, 17-18 MM | GCCGGGGTGGTGCCCATCCTGGAGGAGCTGGACGGCGACGTAAACGGCCACAAGC | 402 |
| Target 2, 19-20 MM | GCCGGGGTGGTGCCCATCCTCCTCGAGCTGGACGGCGACGTAAACGGCCACAAGC | 403 |
| HERC2 Amp Fwd | G*T*G*T*TAATACAAAGGTACAGGAACAAAGAATTTG | 404 |
| HERC2 Amp Rev | CAAAGAGAAGCCTCGGCC | 405 |
| Target 1, Perfect AAAT 3' | TTTATTCAAGGCAATCACTATCAGCTGTGGAACACCCAGGTAAACTAACACAACT | 406 |
| Target 1, Perfect TCGT 3' | TTTATTCAAGGCAATCACTATCAGCTGTGGAACACCCAGGTGCTCTAACACAACT | 407 |
| Target 1, 1-2 MM | TTTATTCAAGGCAATCACTATCAGCTGTGGAACACCCACCTAAACTAACACAACT | 408 |
| Target 1, 3-4 MM | TTTATTCAAGGCAATCACTATCAGCTGTGGAACACCGTGGTAAACTAACACAACT | 409 |

TABLE 6-continued

Oligonucleotides and plasmids used herein.

| DNA Name | Sequence | SEQ ID NO: |
| --- | --- | --- |
| Target 1, 5-6 MM | TTTATTCAAGGCAATCACTATCAGCTGTGGAACAGGCAGGTAAACTAACACAACT | 410 |
| Target 1, 7-8 MM | TTTATTCAAGGCAATCACTATCAGCTGTGGAAGTCCCAGGTAAACTAACACAACT | 411 |
| Target 1, 9-10 MM | TTTATTCAAGGCAATCACTATCAGCTGTGGTTCACCCAGGTAAACTAACACAACT | 412 |
| Target 1, 11-12 MM | TTTATTCAAGGCAATCACTATCAGCTGTCCAACACCCAGGTAAACTAACACAACT | 413 |
| Target 1, 13-14 MM | TTTATTCAAGGCAATCACTATCAGCTCAGGAACACCCAGGTAAACTAACACAACT | 414 |
| Target 1, 15-16 MM | TTTATTCAAGGCAATCACTATCAGGAGTGGAACACCCAGGTAAACTAACACAACT | 415 |
| Target 1, 17-18 MM | TTTATTCAAGGCAATCACTATCTCCTGTGGAACACCCAGGTAAACTAACACAACT | 416 |
| Target 1, 19-20 MM | TTTATTCAAGGCAATCACTAAGAGCTGTGGAACACCCAGGTAAACTAACACAACT | 417 |
| Target 3, Perfect | cTACGCCGattatcttctgacaactttcgcaagcggtgtaaggtaAAAAAtgCGGGCAC | 369 |
| Target 3, 1-2 MM | cTACGCCGattatcttctgacaactttcgcaagcggtgtaaggCGAAAAAtgCGGGCAC | 418 |
| Target 3, 3-4 MM | cTACGCCGattatcttctgacaactttcgcaagcggtgtaaAAtaAAAAAtgCGGGCAC | 419 |
| Target 3, 5-6 MM | cTACGCCGattatcttctgacaactttcgcaagcggtgtGGgtaAAAAAtgCGGGCAC | 420 |
| Target 3, 7-8 MM | cTACGCCGattatcttctgacaactttcgcaagcggtACaaggtaAAAAAtgCGGGCAC | 421 |
| Target 3, 9-10 MM | cTACGCCGattatcttctgacaactttcgcaagcgACgtaaggtaAAAAAtgCGGGCAC | 422 |
| Target 3, 11-12 MM | cTACGCCGattatcttctgacaactttcgcaagTAgtgtaaggtaAAAAAtgCGGGCAC | 423 |
| Target 3, 13-14 MM | cTACGCCGattatcttctgacaactttcgcaGAcggtgtaaggtaAAAAAtgCGGGCAC | 424 |
| Target 3, 15-16 MM | cTACGCCGattatcttctgacaactttcgTGagcggtgtaaggtaAAAAAtgCGGGCAC | 425 |
| Target 3, 17-18 MM | cTACGCCGattatcttctgacaactttTAcaagcggtgtaaggtaAAAAAtgCGGGCAC | 426 |
| Target 3, 19-20 MM | cTACGCCGattatcttctgacaactCCcgcaagcggtgtaaggtaAAAAAtgCGGGCAC | 427 |
| Target 3, 21-22 MM | cTACGCCGattatcttctgacaaTCttcgcaagcggtgtaaggtaAAAAAtgCGGGCAC | 428 |
| Target 3, 23-24 MM | cTACGCCGattatcttctgacGGctttcgcaagcggtgtaaggtaAAAAAtgCGGGCAC | 429 |
| Target 3, 25-26 MM | cTACGCCGattatcttctgGTaactttcgcaagcggtgtaaggtaAAAAAtgCGGGCAC | 430 |
| Full Length Activator | cTACGCCGattatcttctgacaactttcgcaagcggtgtaaggtaAAAAAtgCGGGCAC | 369 |
| -20 5' activator target | tatcttctgacaactttcgcaagcggtgtaaggtaAAAAAtgCGGGCAC | 431 |

TABLE 6-continued

Oligonucleotides and plasmids used herein.

| DNA Name | Sequence | SEQ ID NO: |
|---|---|---|
| -25 5' activator target | tctgacaactttcgcaagcggtgtaaggtaAAAAAtgCGGGCAC | 432 |
| -30 5' activator target | caactttcgcaagcggtgtaaggtaAAAAAtgCGGGCAC | 433 |
| -35 5' activator target | ttcgcaagcggtgtaaggtaAAAAAtgCGGGCAC | 434 |
| -5 3' activator target | cTACGCCGattatcttctgacaactttcgcaagcggtgtaaggtaAAAAAtgCG | 435 |
| -9 3' activator target | cTACGCCGattatcttctgacaactttcgcaagcggtgtaaggtaAAAA | 436 |
| -14 3' activator target | cTACGCCGattatcttctgacaactttcgcaagcggtgta | 437 |
| -19 3' activator target | cTACGCCGattatcttctgacaactttcgcaagcg | 438 |
| -24 3' activator target | cTACGCCGattatcttctgacaactttcgc | 439 |
| -29 3' activator target | cTACGCCGattatcttctgacaact | 440 |
| -34 3' activator target | cTACGCCGattatcttctga | 441 |
| No loop | caactttcgcaagcggtgtaaggtaAAAAAtgCG | 442 |
| 0 nt SL | atggaatgtggcgaacgctttcaacGAAAcaactttcgcaagcggtgtaaggtaAAAAAtgCG | 443 |
| 5 nt SL | atggaatgtggcgaacgcttagttgGAAAcaactttcgcaagcggtgtaaggtaAAAAAtgCG | 444 |
| 10 nt SL | atggaatgtggcgaagcgaaagttgGAAAcaactttcgcaagcggtgtaaggtaAAAAAtgCG | 445 |
| 15 nt SL | atggaatgtgcgcttgcgaaagttgGAAAcaactttcgcaagcggtgtaaggtaAAAAAtgCG | 446 |
| 20 nt SL | atggatacaccgcttgcgaaagttgGAAAcaactttcgcaagcggtgtaaggtaAAAAAtgCG | 447 |
| 25 nt SL | taccttacaccgcttgcgaaagttgGAAAcaactttcgcaagcggtgtaaggtaAAAAAtgCG | 448 |
| M13_1 Oligo | GTTTTATCTTCTGCTGGTGGTTCGTTCGGTATTTTTAATG | 449 |
| M13_2 Oligo | CATTAAAAATACCGAACGAACCACCAGCAGAAGATAAAAC | 450 |
| M13_3 Oligo | GACCATTTGCGAAATGTATCTAATGGTCAAACTAAATCTACTC | 451 |
| M13_4 Oligo | GAGTAGATTTAGTTTGACCATTAGATACATTTCGCAAATGGTC | 452 |

TABLE 7

RNA Oligonucleotides.

| RNA Name | Sequence | SEQ ID NO: |
|---|---|---|
| ssRNA target | cTACGCCGattatcttctgacaactttcgcaagcggtgtaaggtaAAAAAtgCGGGCACcc | 453 |
| crRNA | GGAATGCAACtaccttacaccgcttgcgaa | 454 |
| tracrRNA | CTTCACTGATAAAGTGGAGAACCGCTTCACCAAAAGCTGTCCCTTAGGGGATTAGAACTTGAGTGAAGGTGGGCTGCTTGCATCAGCCTAATGTCGAGAAGTGCTTTCTTCGGAAAGTAACCCTCGAAACAAATTCATTT | 455 |
| crRNA 1 | GACGAATGAAGGAATGCAACtaccttacaccgcttgcgaa | 456 |
| crRNA 2 | GACGAATGAAGGAATGCAACccttacaccgcttgcgaaag | 457 |
| crRNA 3 | GACGAATGAAGGAATGCAACttacaccgcttgcgaaagtt | 458 |
| crRNA 4 | GACGAATGAAGGAATGCAACacaccgcttgcgaaagttgt | 459 |
| crRNA MM target 2 | GACGAATGAAGGAATGCAACCGTCGCCGTCCAGCTCGACCA | 460 |
| crRNA MM target 3 | GACGAATGAAGGAATGCAACGATCGTTACGCTAACTATGA | 461 |
| HERC2 A sgRNA | TTCACTGATAAAGTGGAGAACCGCTTCACCAAAAGCTGTCCCTTAGGGGATTAGAACTTGAGTGAAGGTGGGCTGCTTGCATCAGCCTAATGTCGAGAAGTGCTTTCTTCGGAAAGTAACCCTCGAAACAAATTCATTTgaaaGAATGAAGGAATGCAACacttgacacttaatgctcaa | 462 |
| LbCas12a HERC2 crRNA | GGGTAATTTCTACTAAGTGTAGATacttgacacttaatgctcaa | 463 |
| 25 nt spacer crRNA target 4 | GACGAATGAAGGAATGCAACtaccttacaccgcttgcgaaagttg | 464 |
| 20 nt spacer crRNA target 4 | GACGAATGAAGGAATGCAACtaccttacaccgcttgcgaa | 465 |
| 18 nt spacer crRNA target 4 | GACGAATGAAGGAATGCAACtaccttacaccgcttgcg | 466 |
| 16 nt spacer crRNA target 4 | GACGAATGAAGGAATGCAACtaccttacaccgcttg | 467 |
| 14 nt spacer crRNA target 4 | GACGAATGAAGGAATGCAACtaccttacaccgct | 468 |
| 12 nt spacer crRNA target 4 | GACGAATGAAGGAATGCAACtaccttacaccg | 469 |
| 10 nt spacer crRNA target 4 | GACGAATGAAGGAATGCAACtaccttacac | 470 |
| Full repeat crRNA target 4 | GTTGCAGAACCCGAATAGACGAATGAAGGAATGCAACtaccttacaccgcttgcgaa | 471 |
| 20 nt repeat crRNA target 4 | GACGAATGAAGGAATGCAACtaccttacaccgcttgcgaa | 472 |
| 17 nt repeat crRNA target 4 | GAATGAAGGAATGCAACtaccttacaccgcttgcgaa | 473 |

TABLE 7-continued

RNA Oligonucleotides.

| RNA Name | Sequence | SEQ ID NO: |
|---|---|---|
| 15 nt repeat crRNA target 4 | ATGAAGGAATGCAACtaccttacaccgcttgcgaa | 474 |
| 10 nt repeat crRNA target 4 | GGAATGCAACtaccttacaccgcttgcgaa | 475 |
| tracrRNA +41 nt | CTTCACTGATAAAGTGGAGAACCGCTTCACCAAAAGCTGTC CCTTAGGGGATTAGAACTTGAGTGAAGGTGGGCTGCTTGCA TCAGCCTAATGTCGAGAAGTGCTTTCTTCGGAAAGTAACCCT CGAAACAAATTCATTTTTCCTCTCCAATTCTGCACAAAAAAA GGTGAGTCCTTAT | 476 |
| tracrRNA +3 nt | CTTCACTGATAAAGTGGAGAACCGCTTCACCAAAAGCTGTC CCTTAGGGGATTAGAACTTGAGTGAAGGTGGGCTGCTTGCA TCAGCCTAATGTCGAGAAGTGCTTTCTTCGGAAAGTAACCCT CGAAACAAATTCATTT | 477 |
| tracrRNA -26 | CTTCACTGATAAAGTGGAGAACCGCTTCACCAAAAGCTGTC CCTTAGGGGATTAGAACTTGAGTGAAGGTGGGCTGCTTGCA TCAGCCTAATGTCGAGAAGTGCTTTCTT | 478 |
| tracrRNA -65 | CTTCACTGATAAAGTGGAGAACCGCTTCACCAAAAGCTGTC CCTTAGGGGATTAGAACTTGAGTGAAGGTGG | 479 |
| tracrRNA +0 | TTCACTGATAAAGTGGAGAACCGCTTCACCAAAAGCTGTCC CTTAGGGGATTAGAACTTGAGTGAAGGTGGGCTGCTTGCAT CAGCCTAATGTCGAGAAGTGCTTTCTTCGGAAAGTAACCCT CGAAACAAATTCA | 480 |
| tracrRNA +90 nt | ttcacacTTCACTGATAAAGTGGAGAACCGCTTCACCAAAAGCT GTCCCTTAGGGGATTAGAACTTGAGTGAAGGTGGGCTGCTT GCATCAGCCTAATGTCGAGAAGTGCTTTCTTCGGAAAGTAA CCCTCGAAACAAATTCAttttcctctccaattctgcacaaaaaaaggtgagtcct tataaaccggcgtgcagaacgccggctcaccttttttcttcattcgatttta | 481 |
| sgRNA 1 | CTTCACTGATAAAGTGGAGAACCGCTTCACCAAAAGCTGTC CCTTAGGGGATTAGAACTTGAGTGAAGGTGGGCTGCTTGCA TCAGCCTAATGTCGAGAAGTGCTTTCTTCGGAAAGTAACCCT CGAAACAAATTCATTTgaaaGAATGAAGGAATGCAACtaccttaca ccgcttgcgaa | 482 |
| sgRNA 2 | CTTCACTGATAAAGTGGAGAACCGCTTCACCAAAAGCTGTC CCTTAGGGGATTAGAACTTGAGTGAAGGTGGGCTGCTTGCA TCAGCCTAATGTCGAGAAGTGCTTTCTTCGGAAAGTAACCCT CGAAACAAATTCATTTTTCCTCTCCAATTCTGCACAAgaaaGT TGCAGAACCCGAATAGACGAATGAAGGAATGCAACtaccttacac cgcttgcgaa | 483 |
| M13 target 1 crRNA | GACGAATGAAGGAATGCAACTACCGAACGAACCACCAGCA GAAGA | 484 |
| M13 target 2 crRNA | GACGAATGAAGGAATGCAACTCTTCTGCTGGTGGTTCGTTC GGTA | 485 |
| M13 target 3 crRNA | GACGAATGAAGGAATGCAACGTTTGACCATTAGATACATTT CG | 486 |
| M13 target 4 crRNA | GACGAATGAAGGAATGCAACCGAAATGTATCTAATGGTCAA AC | 487 |

FIG. 17. depicts examples of naturally occurring CasZ protein sequences.

FIG. 18. depicts schematic representations of CasZ loci, which include a Cas1 protein in addition to the CasZ protein.

FIG. 19. depicts a phylogenetic tree of CasZ sequences in relation to other Class 2 CRISPR/Cas effector protein sequences.

FIG. 20. depicts a phylogenetic tree of Cas1 sequences from CasZ loci in relation to Cas1 sequences from other Class 2 CRISPR/Cas loci.

FIG. 21. depicts transcriptomic RNA mapping data demonstrating expression of trancRNA from CasZ loci. The trancRNAs are adjacent to the CasZ repeat array, but do not include the repeat sequence and are not complementary to the repeat sequence. Shown are RNA flapping data for the following loci: CasZa3, CasZb4, CasZc5, CasZd1, and CasZe3 Small repeating aligned arrows represent the repeats of the CRISPR array (indicating the presence of guide RNA-encoding sequence); The peaks outside and adjacent to the repeat arrays represent highly transcribed trancRNAs.

This metatranscriptomic data was not 16S depleted, and hence large portions of the data are mapped to 16S, and mRNA, for example, is almost not represented at all in these reads. Nonetheless, RNA mapping to the predicted trancRNA regions was observed.

Example 6

A set of CRISPR-Cas systems from uncultivated archaea that contained Cas14, a family of exceptionally compact RNA-guided nucleases of just 400-700 amino acids were disclosed herein, including Cas1 and Cas2 proteins that are responsible for integrating DNA into CRISPR genomic loci and showed evidence of actively adapting their CRISPR arrays to new infections. Despite their small size, Cas14 proteins were capable of RNA-guided single-stranded DNA (ssDNA) cleavage without restrictive sequence requirements. Moreover, target recognition by Cas14 triggered non-specific cutting of ssDNA molecules. Metagenomic data showed that multiple CRISPR-Cas14 systems evolved independently and suggested a potential evolutionary origin of single-effector CRISPR-based adaptive immunity Competition between microbes and viruses stimulated the evolution of CRISPR-based adaptive immunity to provide protection against infectious agents. In class 2 CRISPR-Cas systems, a single 100-200 kilodalton (kD) CRISPR-associated (Cas) protein with multiple functional domains carried out RNA-guided binding and cutting of DNA or RNA substrates. To determine whether simpler, smaller RNA-guided proteins occurred in nature, terabase-scale metagenomic datasets were queried for uncharacterized genes proximal to both a CRISPR array and cas1, the gene that encoded the universal CRISPR integrase. This analysis identified a diverse family of CRISPR-Cas systems that contain cas1, cas2, cas4, and cas14, described herein, encoding a 40-70 kD polypeptide (FIG. 30, Panel A). Twenty-four (24) different cas14 gene variants have been identified that cluster into three subgroups (Cas14a-c) based on comparative sequence analysis (FIG. 30, Panels A-B, FIG. 31, FIG. 32). Cas14 proteins were ~400-700 amino acids (aa), about half the size of previously known class 2 CRISPR RNA-guided enzymes (FIG. 30, Panels C-D). While the identified Cas14 proteins exhibited considerable sequence diversity, all were united by the presence of a predicted RuvC nuclease domain, whose organization was characteristic of Type V CRISPR-Cas DNA-targeting enzymes (FIG. 30, Panel D).

The identified Cas14 proteins occurred almost exclusively within DPANN, a super-phylum of symbiotic archaea characterized by small cell and genome sizes. Phylogenetic comparisons showed that Cas14 proteins were widely diverse with similarities to C2c10 and C2c9, families of bacterial RuvC-domain-containing proteins that were sometimes found near a CRISPR array but never together with other cas genes (FIG. 30, Panel B and FIG. 31). This observation and the small size of c2c10 and cas14 genes made it improbable that these systems could function as standalone CRISPR effectors.

FIG. 30, Panels A-D depict architecture and phylogeny of CRISPR-Cas14 genomic loci. FIG. 30, Panel A depicts a phylogenetic tree of Type V CRISPR systems. Newly identified miniature CRISPR systems are highlighted in orange. FIG. 30, Panel B depicts representative loci architectures for C2c10 and CRISPR-Cas14 systems. FIG. 30, Panel C depicts the length distribution of Cas14a-c systems compared to Cas12a-e and Cas9. FIG. 30, Panel D depicts the domain organization of Cas14a compared to Cas9 and Cas12a. Protein lengths are drawn to scale.

FIG. 31 depicts the maximum likelihood tree for known Type V CRISPR effectors and class 2 candidates containing a RuvC domain Inset shows individual orthologs for each newly identified subtype. FIG. 32 depicts a maximum likelihood tree for Cas1 from known CRISPR systems.

Example 7

Based on their proximity to conserved genes responsible for creating genetic memory of infection (cas1, cas2, cas4) (FIG. 33, Panel A), it was explored whether CRISPR-Cas14 systems actively acquired DNA sequences into their CRISPR arrays. Assembled metagenomic contiguous DNA sequences (contigs) for multiple CRISPR-Cas14 loci revealed that otherwise identical CRISPR systems showed diversity in their CRISPR arrays, suggesting active adaptation to new infections (FIG. 33, Panel B and FIG. 34, Panel A). Without intending to be bound by any particular theory, it is proposed that the active acquisition of new DNA sequences indicated that these CRISPR-Cas14 loci encoded functional enzymes with nucleic acid targeting activity despite their small size. To test this possibility, it was investigated whether RNA components were produced from CRISPR-Cas14 loci. Environmental metatranscriptomic sequencing data were analyzed for the presence of RNA from the native archaeal host that contains CRISPR-Cas14a (FIG. 34, Panel B and FIG. 35, Panel A). In addition to CRISPR RNAs (crRNAs), a highly abundant non-coding RNA was mapped to about a 130-base pair sequence located between cas14a and the adjacent CRISPR array. The 20 nucleotides (nts) at the 3' end of this transcript were mostly complementary to the repeat segment of the crRNA (FIG. 34, Panel C and FIG. 35, Panel B), as observed for trans-activating CRISPR RNAs (tracrRNAs) found in association with Cas9, Cas12b and Cas12e CRISPR systems. In these previously studied systems, the double-stranded-RNA-cutting enzyme Ribonuclease III (RNase III) generated mature tracrRNAs and crRNAs, but no genes encoding RNase III were present in cas14-containing reconstructed genomes (FIG. 36, Panel A). This observation implied that an alternative mechanism for CRISPR-associated RNA processing existed in these hosts.

To test whether the Cas14a proteins and associated RNA components could assemble in a heterologous organism, a plasmid was introduced into E. coli containing a minimal CRISPR-Cas14a locus that included the Cas14 gene, the CRISPR array and intergenic regions containing the putative tracrRNA. Affinity purification of the Cas14a protein from cell lysate and sequencing of co-purifying RNA revealed a highly abundant mature crRNA as well as the putative tracrRNA, suggesting that Cas14 associated with both crRNA and tracrRNA (FIG. 36, Panel B). The calculated mass of the assembled Cas14a protein-tracrRNA-crRNA particle was 48% RNA by weight compared to just 17% for S. pyogenes Cas9 (SpCas9) (FIG. 34, Panel D) and 8% for F. novicida Cas12a (FnCas12a), hinting at a central role of the RNA in the architecture of the Cas14a complex. Known class 2 CRISPR systems required a short sequence called a protospacer adjacent motif (PAM) to target double-stranded DNA (dsDNA). To test whether Cas14a required a PAM and could conduct dsDNA interference, E. coli was transformed expressing a minimal Cas14a locus with a dsDNA plasmid containing a randomized PAM region next to a sequence matching the target-encoding sequence (spacer) in the Cas14 array. No depletion of a PAM sequence was detected among E. coli transformants, suggesting that the CRISPR-Cas14a system was either unable to target dsDNA, could do so without requiring a PAM, or was inactive in this heterologous host (FIG. 37, Panels A-D).

FIG. 33, Panels A-B depict acquisition of new spacers by CRISPR-Cas14 systems. FIG. 33, Panel A depicts alignment of Cas14 Cast orthologs. Expansion shows conservation of previously implicated active site residues highlighted in red boxes. FIG. 33, Panel B depicts multiple CRISPR arrays assembled for various CRISPR-Cas14 systems revealing spacer diversity for these CRISPR systems. Orange arrows indicate repeats while variously colored boxes indicate unique spacers.

FIG. 34, Panels A-D depict that CRISPR-Cas14a actively adapts and encodes a tracrRNA. FIG. 34, Panel A depicts pacer diversity for Cas14a and Cas14b with CRISPR repeats diagramed in orange and unique spacers shown in different colors. FIG. 34, Panel B depicts metatranscriptomics reads mapped to Cas14a1 and Cas14a3. Inset shows expansion of most abundant repeat and spacer sequence. FIG. 34, Panel C depicts in silico predicted structure of Cas14a1 crRNA and tracrRNA. RNase III orthologs were not identified in host genomes (FIG. 36, Panel A). FIG. 34, Panel D depicts fraction of various CRISPR complexes mass made up of by RNA and protein.

FIG. 35, Panels A-B depict metatranscriptomics for CRISPR-Cas14 loci. FIG. 35, Panel A depicts environmental RNA sequencing reads for Cas14a orthologs. Location of Cas14 and the CRISPR array indicated below. RNA structures to the right show the in silico predicted structure of the tracrRNA identified from metatranscriptomics. FIG. 35, Panel B depicts predicted hybridization for Cas14a1 crRNA: tracrRNA duplex.

FIG. 36, Panels A-B depict RNA processing and heterologous expression by CRISPR-Cas14. FIG. 36, Panel A depicts the presence of common RNase orthologs in Cas14 containing genomes. Light purple represents hits that were significantly shorter than the expected length for the given RNase. Note that RNase III is absent in all investigated genomes. FIG. 36. Panel B depicts small RNAseq reads from heterologous expression of Cas14a1 locus in *E. coli* (FIG. 36, Panel B, bottom two graphs) compared to metatranscriptomic reads (FIG. 36, Panel B, top graph). Pull down refers to RNA that copurified with Ni-NTA affinity purified Cas14a1.

FIG. 37, Panels A-D depict plasmid depletion by Cas14a1 and SpCas9. FIG. 37, Panel A depicts a diagram outlining a PAM discovery experiment. *E. coli* expressing the CRISPR system of interest was challenged with a plasmid containing a randomized PAM sequence flanking the target. The surviving (transformed) cells were harvested and sequenced along with a control harboring an empty vector. The depleted sequences were then sequenced and PAMs depleted more than the PAM Depletion Value Threshold (PDVT) were used to generate a Weblogo. FIG. 37, Panels B-D depict PAM sequences depleted by heterologously expressed Cas14a1 transformed with a target plasmid containing a randomized PAM sequence 5' (FIG. 37, Panel B) or 3' (FIG. 37, Panel C) of the target. "No sequences" indicated that no sequences were found to be depleted at or above the given PDVT.

Example 8

It was tested whether purified Cas14a-tracrRNA-crRNA complexes were capable of RNA-guided nucleic acid cleavage in vitro. All currently reconstituted DNA-targeting class 2 interference complexes were able to recognize both dsDNA and ssDNA substrates. Purified Cas14a-tracrRNA-crRNA complexes were incubated with radiolabeled target oligonucleotides (ssDNA, dsDNA, and ssRNA) bearing 20-nucleotide sequence complementary to the crRNA guide sequence, or a non-complementary ssDNA, and these substrates were analyzed for Cas14a-mediated cleavage. Only in the presence of a complementary ssDNA substrate was any cleavage product detected (FIG. 38, Panel A and FIG. 39, Panels A-C), and cleavage was dependent on the presence of both tracrRNA and crRNA, which could also be combined into a single-guide RNA (sgRNA) (FIG. 38, Panel B and FIG. 40). The lack of detectable dsDNA cleavage suggested that Cas14a targeted ssDNA selectively, although it was possible that some other factor or sequence requirement could enable dsDNA recognition in the native host. Mutation of the conserved active site residues in the Cas14a RuvC domain eliminated cleavage activity (FIG. 39, Panel A), implicating RuvC as the domain responsible for DNA cutting. Moreover, Cas14a DNA cleavage was sensitive to truncation of the RNA components to lengths shorter than the naturally produced sequences (FIG. 38, Panel B and FIG. 41, Panels A-D). These results established Cas14a as the smallest class 2 CRISPR effector demonstrated to conduct programmable RNA-guided DNA cleavage.

It was tested whether Cas14a required a PAM for ssDNA cleavage in vitro by tiling Cas14a guides across a ssDNA substrate (FIG. 38, Panel C). Despite sequence variation adjacent to the targets of these different guides, cleavage was observed for all four sequences. The cleavage sites occurred beyond the guide-complementary region of the ssDNA and shifted in response to guide binding position (FIG. 38, Panel C). These data demonstrated Cas14a was an ssDNA-targeting CRISPR endonuclease that did not require a PAM for activation.

Based on the observation that Cas14a cut outside of the crRNA/DNA targeting heteroduplex, it was proposed that Cas14a may possess target-activated non-specific ssDNA cleavage activity, similar to the RuvC-containing enzyme Cas12a. To test this possibility, Cas14a-tracrRNA-crRNA was incubated with a complementary activator DNA and an aliquot of M13 bacteriophage ssDNA bearing no sequence complementarity to the Cas14a crRNA or activator (FIG. 38, Panel D). The M13 ssDNA was rapidly degraded to small fragments, an activity that was eliminated by mutation of the conserved Cas14a RuvC active site, suggesting that activation of Cas14a resulted in non-specific ssDNA degradation.

To investigate the specificity of target-dependent non-specific DNA cutting activity by Cas14a, a fluorophore-quencher (FQ) assay was adapted in which cleavage of dye-labeled ssDNA generates a fluorescent signal (FIG. 42, Panel A). When Cas14a was incubated with various guide RNA-target ssDNA pairs, a fluorescent signal was observed only in the presence of the cognate target and showed strong preference for longer FQ-containing substrates (FIG. 41, Panel F and FIG. 42, Panel A). Cas14a mismatch tolerance was tested by tiling 2-nt mismatches across the targeted region in various ssDNA substrates. Mismatches near the middle of the ssDNA target strongly inhibited Cas14a activity, revealing an internal seed sequence that was distinct from the PAM-proximal seed region observed for dsDNA-targeting CRISPR-Cas systems (FIG. 42, Panel B and FIG. 43, Panels A-D). Moreover, DNA substrates containing strong secondary structure resulted in reduced activation of Cas14a (FIG. 43, Panel E). Truncation of ssDNA substrates also resulted in reduced or undetectable trans cleavage (FIG. 43, Panel F). These results suggested a mechanism of fidelity distinct from dsDNA-targeting class 2 CRISPR systems, possibly utilizing a preordered region of the crRNA to gate cleavage activity similarly to the RNA-targeting Cas13a enzymes.

Further investigation of compact Type V systems in metagenomic data revealed a large diversity of systems that, like Cas14a-c, include a gene encoding a short RuvC-containing protein adjacent to acquisition-associated cas genes and a CRISPR array. Twenty (20) additional such systems were found that cluster into five main families (Cas14d-h). These families seemed to have evolved from independent domestication events of TnpB, the transposase-associated protein implicated as the evolutionary parent of type V CRISPR effectors. Excluding cas14g, which was related to cas12b, the cas14-like genes formed separate clades on the type V effector phylogeny (FIG. 44, Panels A-B), and their cas1 genes had different origins (FIG. 32, Panel A). Altogether 38 CRISPR-Cas14 systems belonging to eight families (Cas14a-h) were identified and eight additional systems that could not be clustered with the analysis (termed Cas14u, Table 3).

The small size of the Cas14 proteins described herein and their resemblance to type V effector proteins suggested that RNA-guided ssDNA cleavage may have existed as an ancestral class 2 CRISPR system. In this scenario, a small, domesticated TnpB-like ssDNA interference complex may have gained additional domains over time, gradually improving dsDNA recognition and cleavage. Smaller Cas9 orthologs exhibited weaker dsDNA-targeting activity than their larger counterparts but retained the ability to robustly cleave ssDNA. Aside from the evolutionary implications, the ability of Cas14 to specifically target ssDNA suggested a role in defense against ssDNA viruses or mobile genetic elements (MGEs) that propagated through ssDNA intermediates. Without intending to be bound by any particular theory, an ssDNA-targeting CRISPR system may be particularly advantageous in certain marine environments where ssDNA viruses comprised the vast majority of viral abundance.

FIG. 38, Panels A-D depict CRISPR-Cas14a as an RNA-guided DNA-endonuclease. FIG. 38, Panel A depicts cleavage kinetics of Cas14a1 targeting ssDNA, dsDNA, ssRNA and off-target ssDNA. FIG. 38, Panel B depicts a diagram of Cas14a RNP bound to target ssDNA and Cas14a1 cleavage kinetics of radiolabeled ssDNA in the presence of various RNA components. FIG. 38, Panel C depicts tiling of a ssDNA substrate by Cas14a1 guide sequences. FIG. 38, Panel D depicts cleavage of the ssDNA viral M13 genome with activated Cas14a1.

FIG. 39, Panels A-E depict degradation of ssDNA by Cas14a1. FIG. 39, Panel A depicts SDS-PAGE of purified Cas14a1 and Cas14a1 point mutants. FIG. 39, Panel B depicts optimization of salt, cation and temperature for Cas14a1 cleavage of ssDNA targets. FIG. 39, Panel C depicts radiolabeled cleavage of ssDNA by Cas14a1 with spacer sequences of various lengths. FIG. 39, Panel D depicts alignment of Cas14 with previously studied Cas12 proteins to identify RuvC active site residues and FIG. 39, Panel E depicts cleavage of ssDNA by purified Cas14a1 RuvC point mutants.

FIG. 40 depicts the kinetics of Cas14a1 cleavage of ssDNA with various guide RNA components.

FIG. 41, Panels A-F depict optimization of Cas14a1 guide RNA components. FIG. 41, Panel A depicts a diagram of Cas14a1 targeting ssDNA. Impact on Cas14a1 cleavage of an FQ ssDNA substrate by varying the spacer length (FIG. 41, Panel B), repeat length (FIG. 41, Panel C), tracrRNA (FIG. 41. Panel D), and fusing the crRNA and tracrRNA together (FIG. 41, Panel E). FIG. 41, Panel F depicts a heat map showing the background subtracted fluorescence resulting from cleavage of an ssDNA FQ reporter in the presence of various guide and target combinations.

FIG. 42, Panels A-E depict high fidelity ssDNA SNP detection by CRISPR-Cas14a. FIG. 42, Panel A depicts a fluorescent-quencher (FQ) assay for detection of ssDNA by Cas14a1 and the cleavage kinetics for various length FQ substrates. FIG. 42, Panel B depicts cleavage kinetics for Cas14a1 with mismatches tiled across the substrate (individual points represent replicate measurements). FIG. 42, panel C depicts a diagram of Cas14-DETECTR strategy and HERC2 eye color SNP. FIG. 42, panel D depicts titration of T7 exonuclease and impact on Cas14a-DETECTR. FIG. 42, panel E, depicts SNP detection using Cas14a-DETECTR with a blue-eye targeting guide for a blue-eyed and brown-eyed saliva sample compared to ssDNA detection using Cas12a.

FIG. 43, Panels A-F depict the impact of various activators on Cas14a1 cleavage rate FIG. 43, Panel A depicts a diagram of Cas14a1 targeting of ssDNA with position of mismatches used in panels A-D and raw rates for representative replicates of mismatch (MM) position for Target 1. Cleavage rates for Cas14a targeting substrates with mutations tiled across three different substrates (FIG. 43, Panels B-D). FIG. 43, Panel E depicts trans cleavage rates for substrates with increasing amounts of secondary structure. FIG. 43, Panel F depicts trans leavage rates with truncated substrates. Points represent individual measurements.

FIG. 44, Panels A-B depict diversity of CRISPR-Cas14 systems. FIG. 44, Panel A depicts representative locus architecture for indicated Cas14 systems. Protein lengths are drawn to scale. FIG. 44, Panel B depicts a maximum likelihood tree for Type V effectors including all eight identified subtypes of Cas14.

FIG. 45, Panels A-C depict a test of Cas14a1 mediated interference in a heterologous host. Diagram of Cas14a1 and LhCas12a constructs to test interference in E. coli. (B) Plaques of ΦX174 spotted on E. coli revealing Cas12a—but not Cas14a1-mediated interference. Each spot represents a 10-fold dilution of the DX174 stock. (C) Growth curves of E. coli expressing Cas14a1 or LbCas12a infected with ΦX174 (T, targeting; NT, non-targeting). FIG. 41, Panel F shows a heat map showing the background-subtracted fluorescence resulting from cleavage of a ssDNA FQ reporter in the presence of various guide and target combinations after a 30-minute incubation.

While the present invention has been described with reference to the specific embodiments thereof, it should be understood by those skilled in the art that various changes may be made and equivalents may be substituted without departing from the true spirit and scope of the invention. In addition, many modifications may be made to adapt a particular situation, material, composition of matter, process, process step or steps, to the objective, spirit and scope of the present invention. All such modifications are intended to be within the scope of the claims appended hereto.

REFERENCES

1. R. Barrangou et al., CRISPR provides acquired resistance against viruses in prokaryotes. *Science*. 315, 1709-12 (2007).
2. S. A. Jackson et al., CRISPR-Cas: Adapting to change. *Science*. 356 (6333), pp. 1-9 (2017).

3. S. Shmakov et al., Diversity and evolution of class 2 CRISPR-Cas systems. *Nat. Rev. Microbiol.* 15, 169-182 (2017).
4. J. S. Chen, J. A. Doudna, The chemistry of Cas9 and its CRISPR colleagues. *Nat. Rev. Chem.* 1, 0078 (2017).
5. C. T. Brown et al., Unusual biology across a group comprising more than 15% of domain Bacteria. *Nature.* 523, 208-211 (2015).
6. K. Anantharaman et al., Thousands of microbial genomes shed light on interconnected biogeochemical processes in an aquifer system. *Nat. Commun.* 7, 13219 (2016).
7. V. M. Markowitz et al., IMG/M 4 version of the integrated metagenome comparative analysis system. *Nucleic Acids Res.* 42, 568-573 (2014).
8. V. M. Markowitz et al., IMG: The integrated microbial genomes database and comparative analysis system. *Nucleic Acids Res.* 40, 115-122 (2012).
9. A. J. Probst et al., Genomic resolution of a cold subsurface aquifer community provides metabolic insights for novel microbes adapted to high $CO_2$ concentrations. *Environ. Microbiol.* 19, 459-474 (2017).
10. I. Yosef, M. G. Goren, U. Qimron, Proteins and DNA elements essential for the CRISPR adaptation process in *Escherichia coli. Nucleic Acids Res.* 40, 5569-5576 (2012).
11. J. K. Nuñez, A. S. Y. Lee, A. Engelman, J, a. Doudna, Integrase-mediated spacer acquisition during CRISPR-Cas adaptive immunity. *Nature.* 519, 193-198 (2015).
12. S. Shmakov et al., Discovery and Functional Characterization of Diverse Class 2 CRISPR-Cas Systems. *Mol. Cell.* 60, 385-397 (2015).
13. D. Burstein et al., New CRISPR-Cas systems from uncultivated microbes. *Nature.* 542, 237-241 (2017).
14. C. Rinke et al., Insights into the phylogeny and coding potential of microbial dark matter. *Nature.* 499, 431-437 (2013).
15. C. J. Castelle et al., Genomic expansion of domain archaea highlights roles for organisms from new phyla in anaerobic carbon cycling. *Curr. Biol.* 25, 690-701 (2015).
16. E. Deltcheva et al., CRISPR RNA maturation by trans-encoded small RNA and host factor RNase III. *Nature.* 471, 602-607 (2011).
17. K. E. Savell, J. J. Day, Applications of CRISPR/CAS9 in the mammalian central nervous system. *Yale J. Biol. Med.* 90 (2017), pp. 567-581.
18. F. J. M. Mojica, C. Diez-Villaseñor, J. Garcia-Martinez, C. Almendros, Short motif sequences determine the targets of the prokaryotic CRISPR defence system. *Microbiology.* 155, 733-740 (2009).
19. Y. Zhang, R. Raj an, H. S. Seifert, A. Mondragón, E. J. Sontheimer, DNase H Activity of *Neisseria meningitidis* Cas9. *Mol. Cell.* 60, 242-255 (2015).
20. E. Ma, L. B. Harrington, M. R. O'Connell, K. Zhou, J. A. Doudna, Single-Stranded DNA Cleavage by Divergent CRISPR-Cas9 Enzymes. *Mol. Cell.* 60, 398-407 (2015).
21. J. S. Chen et al., CRISPR-Cas12a target binding unleashes indiscriminate single-stranded DNase activity. *Science.* 360, 436-439 (2018).
22. B. Zetsche et al., Cpf1 Is a Single RNA-Guided Endonuclease of a Class 2 CRISPR-Cas System. *Cell.* 163, 759-771 (2015).
23. A. East-Seletsky et al., Two distinct RNase activities of CRISPR-C2c2 enable guide-RNA processing and RNA detection. *Nature.* 538, 270-273 (2016).
24. L. Liu et al., The Molecular Architecture for RNA-Guided RNA Cleavage by Cas13a. *Cell.* 170, 714-726.e10 (2017).
25. O. O. Abudayyeh et al., C2c2 is a single-component programmable RNA-guided RNA-targeting CRISPR effector. *Science (80-.).* 353, 1-9 (2016).
26. G. J. Knott et al., Guide-bound structures of an RNA-targeting A-cleaving CRISPR-Cas13a enzyme. *Nat. Struct. Mol. Biol.* 24, 825-833 (2017).
27. S. Y. Li et al., CRISPR-Cas12a has both cis- and trans-cleavage activities on single-stranded DNA. *Cell Res.* 28, 491-493 (2018).
28. H. Eiberg et al., Blue eye color in humans may be caused by a perfectly associated founder mutation in a regulatory element located within the HERC2 gene inhibiting OCA2 expression. *Hum. Genet.* 123, 177-187 (2008).
29. S. Shmakov et al., Diversity and evolution of class 2 CRISPR-Cas systems. *Nat. Rev. Microbiol.* 15, 169-182 (2017).
30. E. V Koonin, K. S. Makarova, F. Zhang, Diversity, classification and evolution of CRISPR-Cas systems. *Curr. Opin. Microbiol.* 37, 67-78 (2017).
31. K. S. Makarova et al., An updated evolutionary classification of CRISPR-Cas systems. *Nat Rev Microbiol*, 1-15 (2015).
32. O. Barabas et al., Mechanism of IS 200/IS 605 Family DNA Transposases: Activation and Transposon-Directed Target Site Selection, 208-220 (2008).
33. M. Yoshida et al., Quantitative viral community DNA analysis reveals the dominance of single-stranded DNA viruses in offshore upper bathyal sediment from Tohoku, Japan. *Front. Microbiol.* 9, 1-10 (2018).
34. C. T. Brown et al., Unusual biology across a group comprising more than 15% of domain Bacteria. *Nature.* 523, 208-211 (2015).
35. K. Anantharaman et al., Thousands of microbial genomes shed light on interconnected biogeochemical processes in an aquifer system. *Nat. Commun.* 7, 13219 (2016).
36. A. J. Probst et al., Genomic resolution of a cold subsurface aquifer community provides metabolic insights for novel microbes adapted to high $CO_2$ concentrations. *Environ. Microbiol.* 19, 459-474 (2017).
37. V. M. Markowitz et al., IMG/M 4 version of the integrated metagenome comparative analysis system. *Nucleic Acids Res.* 42, 568-573 (2014).
38. V. M. Markowitz et al., IMG: The integrated microbial genomes database and comparative analysis system. *Nucleic Acids Res.* 40, 115-122 (2012).
39. R. 13. Finn, J. Clements, S. R. Eddy, HMMER web server: interactive sequence similarity searching. *Nucleic Acids Res.* 39, W29-W37 (2011).
40. D. Burstein et al., New CRISPR-Cas systems from uncultivated microbes. *Nature.* 542, 237-241 (2017).
41. I. Grissa, G. Vergnaud, C. Pourcel, CRISPRFinder: a web tool to identify clustered regularly interspaced short palindromic repeats. *Nucleic Acids Res.* 35, W52-W57 (2007).
42. A. Biswas, R. H. J. Staals, S. E. Morales, P. C. Fineran, C. M. Brown, CRISPRDetect: A flexible algorithm to define CRISPR arrays. *BMC Genomics.* 17, 1-14 (2016).
43. A. Starnatakis, RAxML version 8: A tool for phylogenetic analysis and post-analysis of large phylogenies. *Bioinformatics.* 30, 1312-1313 (2014).
44. B. Langmead, S. L. Salzberg, Fast gapped-read alignment with Bowtie 2. *Nat Methods.* 9, 357-359 (2012).
45. H. Ogata et al., KEGG: Kyoto encyclopedia of genes and genomes. *Nucleic Acids Res.* 27, 29-34 (1999).
46. L. B. Harrington et al., A thermostable Cas9 with increased lifetime in human plasma. *Nat. Commun.* 8, 1-7 (2017).

47. G. Crooks, G. Hon, J. Chandonia, S. Brenner, NCBI GenBank FTP Site\nWebLogo: a sequence logo generator. *Genome Res.* 14, 1188-1190 (2004).
48. L. B. Harrington et al., A Broad-Spectrum Inhibitor of CRISPR-Cas9. *Cell.* 170, 1224-1233.e15 (2017).
49. J. S. Chen et al., CRISPR-Cas12a target binding unleashes indiscriminate single-stranded DNase activity. *Science.* 360, 436-439 (2018).
50. Brown et al., Unusual biology across a group comprising more than 15% of domain Bacteria. *Nature.* 523, 208-211 (2015), doi:10.1038/nature14486.

SEQUENCE LISTING (503 sequences)

SEQ ID NO: 1 - protein, 1125 aa, Unknown
  Synthetic sequence
MRKKLFKGYILHNKRLVYTGKAAIRSIKYPLVAPNKTALNNLSEKIIYDYEHLFGPLNVASYARNSNRYSLVDFWIDSLRAGVIWQSKSTSLIDLISKLEGSKSPSEKIFEQIDFELKNKLDKEQFKDIILLNTGIRSSSNVRSLRGRFLKCFKEEFRDTEEVIACVDKWSKDLIVEGKSILVSKQFLYWEEEFGIKIFPHFKDNHDLPKLTFFVEPSLEFSPHLPLANCLERLKKFDISRESLLGLDNNFSAFSNYFNELFNLLSRGEIKKIVTAVLAVSKSWENEPELEKRLHFLSEKAKLLGYPKLTSSWADYRMIIGGKIKSWHSNYTEQLIKVREDLKKHQIALDKLQEDLKKVVDSSLREQIEAQREALLPLLDTMLKEKDFSDDLELYRFILSDFKSLLNGSYQRYIQTEEERKEDRDVTKKYKDLYSNLRNIPRFFGESKKEQFNKFINKSLPTIDVGLKILEDIRNALETVSVRKPPSITEEYVTKQLEKLSRKYKINAFNSNRFKQITEQVLRKYNNGELPKISEVFYRYPRESHVAIRILPVKISNPRKDISYLLDKYQISPDWKNSNPGEVVDLIEIYKLTLGWLLSCNKDFSMDFSSYDLKLFPEAASLIKNFGSCLSGYYLSKMIFNCITSEIKGMITLYTRDKFVVRYVTQMIGSNQKFPLLCLVGEKQTKNFSRNWGVLIEEKGDLGEEKNQEKCLIFKDKTDFAKAKEVEIFKNNIWRIRTSKYQIQFLNRLFKKTKEWDLMNLVLSEPSLVLEEEWGVSWDKDKLLPLLKKEKSCEERLYYSLPLNLVPATDYKEQSAEIEQRNTYLGLDVGEFGVAYAVVRIVRDRIELLSWGFLKDPALRKIRERVQDMKKKQVMAVFSSSSTAVARVREMAIHSLRNQIHSIALAYKAKIIYEISISNFETGGNRMAKIYRSIKVSDVYRESGADTLVSEMIWGKKNKQMGNHISSYATSYTCCNCARTPFELVIDNDKEYEKGGDEFIFNVGDEKKVRGFLQKSLLGKTIKGKEVLKSIKEYARPPIREVLLEGEDVEQLLKRRGNSYIYRCPFCGYKTDADIQAALNIACRGYISDNAKDAVKEGERKLDYILEVRKLWEKNGAVLRSAKFL

SEQ ID NO: 2 - protein, 1226 aa, Unknown
  Synthetic sequence
MQKVRKTLSEVHKNPYGTKVRNAKTGYSLQIERLSYTGKEGMRSFKIPLENKNKEVFDEFVKKIRNDYISQVGLLNLSDWYEHYQEKQEHYSLADFWLDSLRAGVIFAHKETEIKNLISKIRGDKSIVDKFNASIKKKHADLYALVDIKALYDFLTSDARRGLKTEEEFFNSKRNTLFPKFRKKDNKAVDLWVKKFIGLDNKDKLNFTKKFIGFDPNPQIKYDHTFFFHQDINFDLERITTPKELISTYKKFLGKNKDLYGSDETTEDQLKMVLGFHNNHGAFSKYFNASLEAFRGRDNSLVEQIINNSPYWNSHRKELEKRIIFLQVQSKKIKETELGKPHEYLASFGGKFESWVSNYLRQEEEVKRQLFGYEENKKGQKKFIVGNKQELDKIIRGTDEYEIKAISKETIGLTQKCLKLLEQLKDSVDDYTLSLYRQLIVELRIRLNVEFQETYPELIGKSEKDKEKDAKNKRADKRYPQIFKDIKLIPNFLGETKQMVYKKFIRSADILYEGINFIDQIDKQITQNLLPCFKNDKERIEFTEKQFETLRRKYYLMNSSRFHHVIEGIINNRKLIEMKKRENSELKTFSDSKFVLSKLFLKKGKKYENEVYYTFYINPKARDQRRIKIVLDINGNNSVGILQDLVQKLKPKWDDIIKKNDMGELIDAIEIEKVRLGILIALYCEHKFKIKKELLSLDLFASAYQYLELEDDPEELSGTNLGRFLQSLVCSEIKGAINKISRTEYIERYTVQPMNTEKNYPLLINKEGKATWHIAAKDDLSKKKGGGTVAMNQKIGKNFFGKQDYKTVFMLQDKRFDLLTSKYHLQFLSKTLDTGGGSWWKNKNIDLNLSSYSFIFEQKVKVEWDLTNLDHPIKIKPSENSDDRRLFVSIPFVIKPKQTKRKDLQTRVNYMGIDIGEYGLAWTIINIDLKNKKINKISKQGFIYEPLTHKVRDYVATIKDNQVRGTFGMPDTKLARLRENAITSLRNQVHDIAMRYDAKPVYEFEISNFETGSNKVKVIYDSVKRADIGRGQNNTEADNTEVNLVWGKTSKQFGSQIGAYATSYICSFCGYSPYYEFENSKSGDEEGARDNLYQMKKLSRPSLEDFLQGNPVYKTFRDFDKYKNDQRLQKTGDKDGEWKTHRGNTAIYACQKCRHISDADIQASYWIALKQVVRDFYKDKEMDGDLIQGDNKDKRKVNELNRLIGVHKDVPIINKNLITSLDINLL

SEQ ID NO: 3 - protein, 1160 aa, Unknown
  Synthetic sequence
MKAKKSFYNQKRKFGKRGYRLHDERIAYSGGIGSMRSIKYELKDSYGIAGLRNRIADATISDNKWLYGNINLNDYLEWRSSKTDKQIEDGDRESSLLGFWLEALRLGFVFSKQSHAPNDFNETALQDLFETLDDDLKHVLDRKKWCDFIKIGTPKTNDQGRLKKQIKNLLKGNKREEIEKTLNESDDELKEKINRIADVFAKNKSDKYTIFKLDKPNTEKYPRINDVQVAFFCHPDFEEITERDRTKTLDLIINRFNKRYEITENKKDDKTSNRMALYSLNQGYIPRVLNDLFLFVKDNEDDFSQFLSDLENFFSFSNEQIKIIKERLKKLKKYAEPIPGKPQLADKWDDYASDFGGKLESWYSNRIEKLKKIPESVSDLRNNLEKIRNVLKKQNNASKILELSQKIIEYIRDYGVSFEKPEIIKFSWINKTKDGQKKVFYVAKMADREFIEKLDLWMADLRSQLNEYNQDNKVSFKKKGKKIEELGVLDFALNKAKKNKSTKNENGWQQKLSESIQSAPLFFGEGNRVRNEEVYNLKDLLFSEIKNVENILMSSEAEDLKNIKIEYKEDGAKKGNYVLNVLARFYARFNEDGYGGWNKVKTVLENIAREAGTDFSKYGNNNNRNAGRFYLNGRERQVFTLIKFEKSITVEKILELVKLPSLLDEAYRDLVNENKNHKLRDVIQLSKTIMALVLSHSDKEKQIGGNYIHSKLSGYNALISKRDFISRYSVQTTNGTQCKLAIGKGKSKKGNEIDRYFYAFQFFKNDDSKINLKVIKNNSHKNIDFNDNENKINALQVYSSNYQIQFLDWFFEKHQGKKTSLEVGGSFTIAEKSLTIDWSGSNPRVGFKRSDTEEKRVFVSQPFTLIPDDEDKERRKERMIKTKNRFIGIDIGEYGLAWSLIEVDNGDKNNRGIRQLESGFITDNQQQVLKKNVKSWRQNQIRQTFTSPDTKIARLRESLIGSYKNQLESLMVAKKANLSFEYEVSGFEVGGKRVAKIYDSIKRGSVRKKDNNSQNDQSWGKKGINEWSFETTAAGTSQFCTHCKRWSSLAIVDIEEYELKDYNDNLFKVKINDGEVRLLGKKGWRSGEKIKGKELFGPVKDAMRPNVDGLGMKIVKRKYLKLDLRDWVSRYGNMAIFICPYVDCHHISHADKQAAFNIAV

SEQ ID NO: 4 - protein, 1210 aa, Unknown
  Synthetic sequence
MSKRHPRISGVKGYRLHAQRLEYTGKSGAMRTIKYPLYSSPSGGRTVPREIVSAINDDYVGLYGLSNFDDLYNAEKRNEEKVYSVLDFWYDCVQYGAVFSYTAPGLLKNVAEVRGGSYELTKTLKGSHLYDELQIDKVIKFLNKKEISRANGSLDKLKKDIIDCFKAEYRERHKDQCNKLADDIKNAKKDAGASLGERQKKLFRDFFGISEQSENDKPSFTNPLNLTCCLLPFDTVNNNRNRGEVLFNKLKEYAQKLDKNEGSLEMWEYIGIGNSGTAFSNFLGEGFLGRLRENKITELKKAMMDITDAWRGQEQEEELEKRLRILAALTIKLREPKFDNHWGGYRSDINGKLSSWLQNYINQTVKIKEDLKGHKKDLKKAKEMINRFGESDTKEEAVVSSLLESIEKIVPDDSADDEKPDIPAIAIYRRFLSDGRLTLNRFVQREDVQEALIKERLEAEKKKKPKKRKKKSDAEDEKETIDFKELFPHLAKPLKLVPNFYGDSKRELYKKYKNAAIYTDALWKAVEKIYKSAFSSSLKNSFFDTDFDKDFFIKRLQKIFSVYRRFNTDKWKPIVKNSFAPYCDIVSLAENEVLYKPKQSRSRKSAAIDKNRVRLPSTENIAKAGIALARELSVAGFDWKDLLKKEEHEEYIDLIELHKTALALLLAVTETQLDISALDFVENGTVKDFMKTRDGNLVLEGRFLEMFSQSIVFSELRGLAGLMSRKEFITRSAIQTMNGKQAELLYIPHEFQSAKITTPKEMSRAFLDLAPAEFATSLEPESLSEKSLLKLKQMRYYPHYFGYELTRTGQGIDGGVAENALRLEKSPVKKREIKCKQYKTLGRGQNKIVLYVRSSYYQTQFLEWFLHRPKNVQTDVAVSGSFLIDEKKVKTRWNYDALTVALEPVSGSERVFVSQPFTIFPEKSAEEEGQRYLGIDIGEYGIAYTALEITGDSAKILDQNFISDPQLKTLREEVKGLKLDQRRGTFAMPSTKIARIRESLVHSLRNRIHHLALKHKAKIVYELEVSRFEEGKQKIKKVYATLKKADVYSEIDADKNLQTTVWGKLAVASEISASYTSQFCGACKKLWRAEMQVDETITTQELIGTVRVIKGGTLIDAIKDFMRPPIFDENDTPFPKYRDFCDKHHISKKMRGNSCLFICPFCRANADADIQASQTIALLRYVKEEKKVEDYFERFRKLKNIKVLGQMKKI

SEQ ID NO: 5 - protein, 1287 aa, Unknown
  Synthetic sequence
MKRILNSLKVAALRLLFRGKGSELVKTVKYPLVSPVQGAVEELAEAIRHDNLHLFGQKEIVDLMEKDEGTQVYSVVDFWLDTLRLGMFFSPSANALKITLGKFNSDQVSPFRKVLEQSPFFLAGRLKVEPAERILSVEIRKIGKRENRVENYAADVETCFIGQLSSDEKQSIQKLANDIWDSKDHEEQRMLKADFFAIPLIKDPKAVTEEDPENETAGKQKPLELCVCLVPELYTRGFGSIADFLVQRLTLLRDKMSTDTAEDCLEYVGIEEEKGNGMNSLLGTFLKNLQGDGFEQIFQFMLGSYVGWQGKEDVLRERLDLLAEKVKRLPKPKFAGEWSGHRMFLHGQLKSWSSNFFRLFNETRELLESIKSDIQHATMLISYVEEKGGYHPQLLSQYRKLMEQLPALRTKVLDPEIEMTHMSEAVRSYIMIHKSVAGFLPDLLESLDRDKDREFLLSIFPRIPKIDKKTKEIVAWELPGEPEEGYLFTANNLFRNFLENPKHVPRFMAERIPEDWTRLRSAPVWFDGMVKQWQKVVNQLVESPGALYQFNESFLRQRLQAMLTVYKRDLQTEKFLKLLADVCRPLVDFFGLGGNDIIFKSCQDPRKQWQTVIPLSVPADVYTACEGLAIRLRETLGFEWKNLKGHEREDFLRLHQLLGNLLFWIRDAKLVVKLEDWMNNPCVQEYVEARKAIDLPLEIFGFEVPIFLNGYLFSELRQLELLLRRKSVMTSYSVKTTGSPNRLFQLVYLPLNPSDPEKKNSNNFQERLDTPTGLSRRFLDLTLDAFAGKLLTDPVTQELKTMAGFYDHLFGFKLPCKLAAMSNHPGSSSKMVVLAKPKKGVASNIGFEPIPDPAHPVFRVRSSWPELKYLEGLLYLPEDTPLTIELAETSVSCQSVSSVAFDLKNLTTILGRVGEFRVTADQPFKLTPIIPEKEESFIGKTYLGLDAGERSGVGFAIVTVDGDGYEVQRLGVHEDTQLMALQQVASKSLKEPVFQPLRKGTFRQQERIRKSLRGCYWNFYHALMIKYRAKVVHEESVGSSGLVGQWLRAFQKDLKKADVLPKKGGKNGVDKKKRESSAQDTLWGGAFSKKEEQQIAFEVQAAGSSQFCLKCGWWFQLGMREVNRVQESGVVLDWNRSIVTFLIESSGEKVYGFSPQQLEKGFRPDIETFKKMVRDFMRPPMFDRKGRPAAAYERFVLGRRHRRYRFDKVFEERFGRSALFICPRVGCGNFDHSSEQSAVVLALIGYIADKEGMSGKKLVYVRLAELMAEWKLKKLERSRVEEQSSAQ

SEQ ID NO: 6 - protein, 1192 aa, Unknown
  Synthetic sequence
MAESKQMQCRKCGASMKYEVIGLGKKSCRYMCPDCGNHTSARKIQNKKKRDKKYGSASKAQSQRIAVAGALYPDKKVQTIKTYKYPADLNGEVHDSGVAEKIAQAIQEDEIGLLGPSSEYACWIASQKQSEPYSVVDFWFDAVCAGGVFAYSGARLLSTVLQLSGEESVLRAALASSPFVDDINLAQAEKFLAVSRRTGQDKLGKRIGECFAEGRLEALGIKDRMREFVQAIDVAQTAGQRFAAKLKIFGISQMPEAKQWNNDSGLTVCILPDYYVPEENRADQLVVLLRRLREIAYCMGIEDEAGFEHLGIDPGALSNFSNGNPKRGFLGRLLNNDIIALANNMSAMTPYWEGRKGELIERLAWLKHRAEGLYLKEPHFGNSWADHRSRIFSRIAGWLSGCAGKLKIAKDQISGVRTDLFLLKRLLDAVPQSAPSPDFIASISALDRFLEAAESSQDPAEQVRALYAFHLNAPAVRSIANKAVQRSDSQEWLIKELDAVDHLEFNKAFPFFSDTGKKKKKGANSNGAPSEEEYTETESIQQPEDAEQEVNGQEGNGASKNQKKFQRIPRFFGEGSRSEYRILTEAPQYFDMFCNNMRAIFMQLESQPRKAPRDFKCFLQNRLQKLYKQTFLNARSNKCRALLESVLISWGEFYTYGANEKKFRLRHEASERSSDPDYVVQQALEIARRLFLFGFEWRDCSAGERVDLVEIHKKAISFLLAITQAEVSVGSYNWLGNSTVSRYLSVAGTDTLYGTQLEEFLNATVLSQMRGLAIRLSSQELKDGFDVQLESSCQDNLQHLLVYRASRDLAACKRATCPAELDPKILVLPVGAFIASVMKMIERGDEPLAGAYLRHRPHSFGWQIRVRGVAEVGMDQGTALAFQKPTESEPFKIKPFSAQYGPVLWLNSSSYSQSQYLDGFLSQPKNWSMRVLPQAGSVRVEQRVALIWNLQAGKMRLERSGARAFFMPVPFSFRPSGSGDEAVLAPNRYLGLFPHSGGIEYAVVDVLDSAGFKILERGTIAVNGFSQKRGERQEEAHREKQRRGISDIGRKKPVQAEVDAANELHRKYTDVATRLGCRIVVQWAPQPKPGTAPTAQTVYARAVRTEAPRSGNQEDHARMKSSWGYTWGTYWEKRKPEDILGISTQVYWTGGIGESCPAVAVALLGHIRATSTQTEWEKEEVVFGRLKKFFPS

SEQ ID NO: 7 - protein, 1192 aa, Artificial Sequence
  Synthetic sequence
MAESKQMQCRKCGASMKYEVIGLGKKSCRYMCPDCGNHTSARKIQNKKKRDKKYGSASKAQSQRIAVAGALYPDKKVQTIKTYKYPADLNGEVHDRGVAEKIEQAIQEDEIGLLGPSSEYACWIASQKQSEPYSVVDFWFDAVCAGGVFAYSGARLLSTVLQLSGEESVLRAALASSPFVDDINLAQAEKFLAVSRRTGQDKLGKRIGECFAEGRLEALGIKDRMREFVQAIDVAQTAGQRFAAKLKIFGISQMPEAKQWNNDSGLTVCILPDYYVPEENRADQLVVLLRRLREIAYCMGIEDEAGFEHLGIDPGALSNFSNGNPKRGFLGRLLNNDIIALANNMSAMTPYWEGRKGELIERLAWLKHRAEGLYLKEPHFGNSWADHRSRIFSRIAGWLSGCAGKLKIAKDQISGVRTDLFLLKRLLDAVPQSAPSPDFIASISALDRFLEAAESSQDPAEQVRALYAFHLNAPAVRSIANKAVQRSDSQEWLIKELDAVDHLEFNKAFPFFSDTGKKKKKGANSNGAPSEEEYTETESIQQPEDAEQEVNGQEGNGASKNQKKFQRIPRFFGEGSRSEYRILTEAPQYFDMFCNNMRAIFMQLESQPRKAPRDFKCFLQNRLQKLYKQTFLNARSNKCRALLESVLISWGEFYTYGANEKKFRLRHEASERSSDPDYVVQQALEIARRLFLFGFEWRDCSAGERVDLVEIHKKAISFLLAITQAEVSVGSYNWLGNSTVSRYLSVAGTDTLYGTQLEEFLNATVLSQMRGLAIRLSSQELKDGFDVQLESSCQDNLQHLLVYRASRDLAACKRATCPAELDPKILVLPAGAFIASVMKMIERGDEPLAGAYLRHRPHSFGWQIRVRGVAEVGMDQGTALAFQKPTESEPFKIKPFSAQYGPVLWLNSSSYSQSQYLDGFLSQPKNWSMRVLPQAGSVRVEQRVALIWNLQAGKMRLERSGARAFFMPVPFSFRPSGSGDEAVLAPNRYLGLFPHSGGIEYAVVDVLDSAGFKILERGTIAVNGFSQKRGERQEEAHREKQRRGISDIGRKKPVQAEVDAANELHRKYTDVATRLGCRIVVQWAPQPKPGTAPTAQTVYARAVRTEAPRSGNQEDHARMKSSWGYTWSTYWEKRKPEDILGISTQVYWTGGIGESCPAVAVALLGHIRATSTQTEWEKEEVVFGRLKKFFPS

SEQ ID NO: 8 - protein, 1193 aa, Artificial Sequence
  Synthetic sequence
MKRIAKFRHDKPVKREAWSKGYRVHKNRIINKVTRSIKYPLVVKDEWKKRLIDDAAHDYRWLVGPINYSDWCRDPNQYSILEFWIDFLCVGGVFQSSHSNICRLAIQLSGGSVFEQEWKDLSPFVRANLIQGIKPAEFIGFLTAEFRSSSNPKNFISKFFEGSNEDLESLTNEFASIVDFIKAKDISLLRKSLPSCKKIAPNLWEKAVGSHSTNELLKLLTKYTRVMLVAEPSHSDRVFSQTVLQSNDQDDPELTGPLPSHKVGKASYLFIPEFIREVNLDKISKLDLSAKSKLAVEQVKKLSELTSDFKQIENQSEAYFGLSTSFNELSNFLGILIRTLRNAPEAILKDQIALCAPLDKDILKITLDWLCDRAQALPENPRFETNWAEYRSYLGGKIKSWFSNYENFFEIPQAASSQQNNNREKKLGNRSAIRALNLKKEAFEKARETFKGDKGTLEKIDLAYRLLGSISPEVLQCDEGLKLYQQFNDELLVLNETINQKFQDAKRDIKAKKEKESFEKLQRNLSSPLPRIPEFFGERAKKGYQKARVSPKLARHLLECLNDWLARFAKVEESAFSEKEFQRILDWLRTSDFLPVFIRKSKDPPSWLRYIARVATGKYYFWVSEYSRKRVQIIDKPIAQNPLKELISWFLLNKDAFSRDNELFKGLSSKMVTLARIMAGILRDRGEGLKELQAMTSKLDNIGLLHPSFSVPVTDSLKDAAFYRAFFSELEGLLNIGRSRLIIERITLQSQQSKNKKTRRPLMPEPFINEDKEVFLAFPKFETKNKVKGTRVVYNSPDEVNWLLSPIRSSKGQLSFMFRCLSEDAKIMTTSGGCSYIVEFKKLLEAQEEVLSIHDCDIIPRAFVSIPFTLERESEETKPDWKPNRFMGVDIGEYAVAYCVIEKGTDSIEILDCGIVRNGAHRVLKEKVDRLKRRQRSMTFGAMDTSIAAARESLVGNYRNRLHAIALKHGAKLVYEYEVSAFESGGNRIKKVYETLKKSDCTGETEADKNARKHIWGETNAVGDQIGAGWTSQTCAKCGRSFGADLKAGNFGVAVPVPEKVEDSKGHYAYHEFPFEDGLKVRGFLKPNKIISDQKELAKAVHAYMRPPLVALGKRKLPKNARYRRGNSSLFRCPFSDCGFTADADIQAAYNIAVKQLYKPKKGYPKERKWQDFVILKPKEPSKLFDKQFYRPN

SEQ ID NO: 9 - DNA, 40 bp, Artificial Sequence
  Synthetic sequence
gacatgatcgctaatcaataccaaactctggaccgaattc

SEQ ID NO: 10 - DNA, 40 bp, Artificial Sequence
  Synthetic sequence
ctgtactagcgattagttatggtttgagacctggcttaag

SEQ ID NO: 11 - protein, 1218 aa, Artificial Sequence
  Synthetic sequence
MTKHSIPLHAFRNSGADARKWKGRIALLAKRGKETMRTLQFPLEMSEPEAAAINTTPFAVAYNAIEGTGKGTLFDYWAKLHLAGFRFFPSGGAATIFRQQAVFEDASWNAAFCQQSGKDWPWLVPSKLYERFTKAPREVAKKDGSKKSIEFTQENVANESHVSLVGASITDKTPEDQKEFFLKMAGALAEKFDSWKSANEDRIVAMKVIDEFLKSEGLHLPSLENIAVKCSVETKPDNATVAWHDAPMSGVQNLAIGVFATCASRIDNIYDLNGGKLSKLIQESATTPNVTALSWLFGKGLEYFRTTDIDTIMQDFNIPASAKESIKPLVESAQAIPTMTVLGKKNYAPFRPNFGGKIDSWIANYASRLMLLNDILEQIEPGFELPQALLDNETLMSGIDMTGDELKELIEAVYAWVDAAKQGLATLLGRGGNVDDAVQTFEQFSAMMDTLNGTLNTISARYVRAVEMAGKDEARLEKLIECKFDIPKWCKSVPKLVGISGGLPKVEEEIKVMNAAFMDVRARMFVRFEEIAAYVASKGAGMDVYDALEKRELEQLKKLKSAVPERAHIQAYRAVLHRIGRAVQNCSEKTKQLFSSKVIEMGVFKNPSHLNNFIFNQKGAIYRSPFDRSRHAPYQLHADKLLKNDWMELLAEISTTLMASESTEQMEDALRLERTRLQLQLSGLPDWEYPASLAKPDIEVEIQTALKMQLAKDTVTSDVLQRTFNLYSSVLSGLTFKLLRRSFSLKMRFSVADTTQLIYVPKDCDWAIPKQYLQAEGEIGIAARVVTESSPAKMVTEVEMKEPKALGHFMQQAPHDWYFDASLGGTQVAGRIVEKGKEVGKERKLVGYRMRGNSAYKTVLDKSLVGNTELSQCSMIIEIPYTQTVDADFRAQVQAGLPKVSINLPVKETITASNKDEQMLFDRFVAIDLGERGLGYAVFDAKTLELQESGHRPIKAITNLLNRTRHYEQRPNQRQKFQAKFNVNLSELRENTVGDVCHQINRICAYYNAFPVLEYMVPDRLDKQLKSVYESVTNRYIWSSTDAHKSARVQFWLGGETWEHPYLKSAKDKKPLVLSPGRGASGKGTSQTCSCCGRNPFDLIKDMKPRAKIAVVDGKAKLENSELKLFERNRESKDDMLARRHRNERAGMEQPLTPGNYTVDEIKALLRANLRRAPKNRRTKDTTVSEYHCVFSDCGKTMHADENAAVNIGGKFIADIEK

SEQ ID NO: 12 - protein, 1222 aa, Artificial Sequence
  Synthetic sequence
MKKFELKQNFRNNYSGKTLRNFRQTLAQIANKKSSDSILTIKFKLDCSKTGKLPKYENLISLYDTIEDIKKGTLSYYLFTLIVSGFKFFGSASQAKAFSTKDIFKDNDFYNQFKIQSHLDLPDFVPSKIYQRLKKNVRSTNGKDNAFKASVIVAEYRKEIGKLKNKDESSEHQCEELFKKIGTALETRFSSWQDLINNCSTGCEIIDEILNDSFGTLPSIKKMVLASTTQSSDGEQDGIAIAYDPDSTFIKSDELLNPYFAVATILKSMPPEIQQDKKSAYVKANLTTPTHNALSWIFGKGLTLFQTESTEKLCAMFNVSDKRVIEQVQDAAKAVKLPAELDLNHCTLKFQDFRSSLGGHLDSWTTNYLKRLDELNDLLLNLPKNLSLPDIFMIDGKDFIEYSGCNRDEIQQMIDFVVNEQNRIKLQESLNALLGKGNNQICSDDISTVKDFSEIVNSLHSFVQQIDNSLEQSSNEANSIFSELKKKIEKNEKWDIWKNNLKKIPKLNKLSGGVPDAWKEIREIEQKFHEISENQKKHFTEVMEWIDAGNGTIDIFESRFKYDELLKKSKKNNLQSADELAFRSVLNKLGRFARQGNDLVCEKIKNWFKEQNIFDSSKDFNRYFINQKGFIFKHPSSKKDNSPYNLSANLLEKRYEVTNTVGALLEQCESDPAIVNDPFSMRSLVEFRALWFSINISGISKEQHIPTKIAQPKLDDSTYQESVSPTLKYRLEKEQITSSELNSIFTVYKSLLSGLSIRLSRNSFYLRTKFSWIGNNSLIYCPKETTWKIPAAYFKSDLWNEYKDKQILIVNEEYDVDVVKTFESVYKIVKSKDNNEKNRILPLLKQLPHDWMFKLPFGASNAEKCKVLKLEKNNKKFKPLSVSKDSLARLSGPSTYFNQIDEIMMNDESELSEMTLLADEPVRQQMSNGKIEIIPDDYVMSLAIPITRSLKKGNTESFPFKNIVSIDQGEAGFAYAVFKLSDCGNERAEPIATGLIPIPSIRRLIHSVKKYRGKKQRIQNFNQKFDSTMFTLRENVTGDICGLIVALMKKYNAFPILEKQVGNLESGSKQLMLVYKAVNSKFLAAKVDMQNDQRRSWWYQGNSWNTPILRISNPNQSNNKNIVKNINGKKYEELKIYPGYSVSAYMTSCICHVCGRNALELLKNDDSTGKVKKYQINQDGEVTIGGEVIKLYRKPDRLTPVKNLAKKGNRERTYASINERAP

SEQ ID NO: 13 - protein, 1252 aa, Artificial Sequence
  Synthetic sequence
MTKLRHRQKKLTHDWAGSKKREVLGSNGKLQNPLLMPVKKGQVTEFRKAFSAYARATKGEMTDGRKNMFTHSFEPFKTKPSLHQCELADKAYQSLHSYLPGSLAHFLLSAHALGFRIFSKSGEATAFQASSKIEAYESKLASELACVDLSIQNLTISTLFNALTTSVRGKGEETSADPLIARFYTLLTGKPLSRDTQGPERDLAEVISRKIASSFGTWKEMTANPLQSLQFFEEELHALDANVSLSPAFDVLIKMNDLQGDLKNRTIVFDPDAPVFEYNAEDPADIIIKLTARYAKEAVIKNQNVGNYVKNAITTTNANGLGWLLNKGLSLLPVSTDDELLEFIGVERSHPSCHALIELIAQLEAPELFEKNVFSDTRSEVQGMIDSAVSNHIARLSSSRNSLSMDSEELERLIKSFQIHTPHCSLFIGAQSLSQQLESLPEALQSGVNSADILLGSTQYMLTNSLVEESIATYQRTLNRINYLSGVAGQINGAIKRKAIDGEKIHLPAAWSELISLPFIGQPVIDVESDLAHLKNQYQTLSNEFDTLISALQKNFDLNFNKALLNRTQHFEAMCRSTKKNALSKPEIVSYRDLLARLTSCLYRGSLVLRRAGIEVLKKHKIFESNSELREHVHERKHFVFVSPLDRKAKKLLRLTDSRPDLLHVIDEILQHDNLENKDRESLWLVRSGYLLAGLPDQLSSSFINLPIITQKGDRRLIDLIQYDQINRDAFVMLVTSAFKSNLSGLQYRANKQSFVVTRTLSPYLGSKLVYVPKDKDWLVPSQMFEGRFADILQSDYMVWKDAGRLCVIDTAKHLSNIKKSVFSSEEVLAFLRELPHRTFIQTEVRGLGVNVDGIAFNNGDIPSLKTFSNCVQVKVSRTNTSLVQTLNRWFEGGKVSPPSIQFERAYYKKDDQIHEDAAKRKIRFQMPATELVHASDDAGWTPSYLLGIDPGEYGMGLSLVSINNGEVLDSGFIHINSLINFASKKSNHQTKVVPRQQYKSPYANYLEQSKDSAAGDIAHILDRLIYKLNALPVFEALSGNSQSAADQVWTKVLSFYTWGDNDAQNSIRKQHWFGASHWDIKGMLRQPPTEKKPKPYIAFPGSQVSSYGNSQRCSCCGRNPIEQLREMAKDTSIKELKIRNSEIQLFDGTIKLFNPDPSTVIERRRHNLGPSRIPVADRTFKNISPSSLEFKELITIVSRSIRHSPEFIAKKRGIGSEYFCAYSDCNSSLNSEANAAANVAQKFQKQLFFEL

SEQ ID NO: 14 - protein, 1271 aa, Artificial Sequence
  Synthetic sequence
MATKKLMKSGAQLRAFRRYLASRADRPAEKYTRTLKFPLEDTGFFNNPEDFQAAVKLYNITEGVEVYTLYGLLMRLHLGGFRLFSSATKAYTFRNSEVFDNAQFRMALQDTFGVESKKLDVESIYGDLKRARRNTGGRVKHLSGRELAEDYYQRATGKKVDTGSSDFNAGLFDFLKTFGRAIEEKFSSWAEVNEDINSGNNVAITCLDKTLAEYSVSLPLINGQLALLSEAKQSNSTIAFDRNKKIIANYPIEIAIHIVVAQYLQEIQKEAPTKSAAIKHLQSNITTETHSGLSWLLGAGLKYLAVTDDKIILDELEITNAKAVGELTDIARTISPVAFLGDNNYSSYRRTFGGKLDSWTANYATRLYELDAALIGMDAAFCLPASLSDPRAASLLDGMAVNITELNALVKGLYSRRDDARVSLNQLLGRDLELPELGDVETVEAFSDELNAVSGLLNMLGNRLKQEQEYAEASRNIPQEDFLRSCSFTKPVWLKKLPKLNQISGGVPDYKQELKQSVEDFNVTRQLMQAHFARIEKYVKDHHIALDVLGNLATREQLHINRFREQRPSVTTRESATTRAYRNLFHRIAKVGMSCSPEVKDKVKALLQSWDVFSSKKDLNRLFNNRQGAIYQSLFSTRQHDPYALNEEALNTKPYMDLFRDFITQLQTQIYESGFSKYNDLLKLERTYYGLMLGGLPDNLPKALGELALPEHLMNLSPILKGALSQKTLSTETIIKAFNHYHSVLNGLAAKLLREEFLVRAKFTRVGDTALVYQAKDKIWTVPERYITTNKEIGSVFKQPPLANLLDDNKLEVRAGIEALSSAYRSDWGQRAKDGALTPYLRQSPHDWKYALDYGASKGTREPGFKCDKKAPRKYSDSHTGLVRLIGPSSFKEWLDKAMLTKEAEIGDQTLIIDQRIKQSIQQTETGIEVVTEPSGGIINLAVPLTELLPKGEPEFILDHFVAIDLGEVGIGYAVFKVDDFKLVAHGSIPIRSIRNLMSSVERHRRLRQPQQKFQASYNPLLSQLRQNAIGDTLGVVDGLMEQFNAFPVFESSVGNFERGANQLKIIYESVLKNYTFSNIDAHKATRKHHWCGGEKWTHPELRVWELNDKGERTGSDRQLNLFPGASVHPAGTSQTCSKCQRNPIKEVYAVLDADARTVFKVDAKGEYKLSSGNSICLYTTPRLSSKELKNTRRCKLNRQPTAKLMDEFKGDEMLKAIRRCLRFKQKSSRSKDTSQSRYRCLYSDCGHSMHADENAAINIGLKWVREKVVP

SEQ ID NO: 15 - protein, 1271 aa, Artificial Sequence
  Synthetic sequence
MINKWMMQSGAQLRAFRCAVTQTSNRPPKKITRTLKFPLEETDFFDNPDNFEAATALYQITEGIGTESIYGLLMRLHLAGFRLFASSNEARTFCNRSSFDNSAFRQALLDTFGVQSKHLDIEAIYLDLRKQRRVINGKVKALSAQALAESYYLLAIGSVANSEKPNFNKAFFNFLYDFGQALEGSFASWAEVNADITCSDSTALTHLDHTIKQHGLNLPSVKQKITQLRDLKPENCPVVFDGNKIIVEQYPDDIAIHIVTAQYLQEIQSTKPSCKQAVDHVQGRITTQTHNGLSWLLGVGLDYLATTNIKQIAQDWNTSKSAVLQQLIDIAKALLPVPFLDNRNYAKYRRSVGGKLDSWLANYINRLFDLHSALESTQCDFALPKALSTEDASAFFTGMTVNYTEFSALIETLNKTMQQAENALQRLFGCSTSLPDAQDVQAIEQLSKQLNTVSGLLNMLDNRLEQERKIAKDNNQQQKLELLDQCAFDSPDWLKELPKLNAISGGVPDYQQQLQQTAKDFNLTYTVMHQHYARIKNYCSKQSIALDVLGNITAKEQQYIERFKTLRINAKTAESPLIRAHRNILHRIAKVASNCSPVVREQVRQLFLDWGVFKSKKHLNSFFINRKGAIYQSLFSRSNHQPYALDETALANTNYLQAFSQYLNKLEQQCNDNFALYSDSLALRKVYYTIMLSGLPDDLPAEIGQIALPEHLLNLSPILKAALEQQTLRAETLIKVFNYYHSLLNGFTAFLVRDEFIVRTKFTRVADIELIYQAKNKIWQVPEHYIKSPKAIGKVLAQLPLNELLNDNQLNVPEGIEALSKHHKKHWATDTRNGELDFLRQSPHDWKYQLGYGQTQQKQSGFKCFGKKNKRNQNYTGHTGLVRLIGPSTTKEWLDKAMLTNQAEIGDITLLIDQHIKQTIDANNAGISLKTQPAGGQITLAVPVTEWLAEDKENIFDYFVAIDLGEVGIGYAVFAVDGFNLIAQGNIAIRSIRNLIGAVNRHRGNRQPRQKFQASYQPQLARLRNNAIGDTLGVIDGLMQGFSAFPIFESSVGSFERGARQLKMIYESVLKNYTFSNVGAHKAARKHHWCGGDRWLHPSLQVWKINEKGENTGKKKPLNLFPGASVHPAGTSQTCSQCGRNPLQGLRSFTDKNRRPPFIPNSNSEYQLPSGESIYLYTYPTLTTQQQRERRRQKLNPQPTERMSKELYGDEIIKAIKRCLRFKPDSSRSKDTSQSQYRCLYSDCGHAMHADENAAINIGNKWMNTKLVRNS

SEQ ID NO: 16 - protein, 1302 aa, Artificial Sequence
  Synthetic sequence
MQTKKTHLHLISAKASRKYRRTIACLSDTAKKDLERRKQSGAADPAQELSCLKTIKFKLEVPEGSKLPSFDRISQIYNALETIEKGSLSYLLFALILSGFRIFPNSSAAKTFASSSCYKNDQFASQIKEIFGEMVKNFIPSELESILKKGRRKNNKDWTEENIKRVLNSEFGRKNSEGSSALFDSFLSKFSQELFRKFDSWNEVNKKYLEAAELLDSMLASYGPFDSVCKMIGDSDSRNSLPDKSTIAFTNNAEITVDIESSVMPYMAIAALLREYRQSKSKAAPVAYVQSHLTTTNGNGLSWFFKFGLDLIRKAPVSSKQSTSDGSKSLQELFSVPDDKLDGLKFIKEACEALPEASLLCGEKGELLGYQDFRTSFAGHIDSWVANYVNRLFELIELVNQLPESIKLPSILTQKNHNLVASLGLQEAEVSHSLELFEGLVKNVRQTLKKLAGIDISSSPNEQDIKEFYAFSDVLNRLGSIRNQIENAVQTAKKDKIDLESAIEWKEWKKLKKLPKLNGLGGGVPKQQELLDKALESVKQIRHYQRIDFERVIQWAVNEHCLETVPKFLVDAEKKKINKESSTDFAAKENAVRFLLEGIGAAARGKTDSVSKAAYNWFVVNNFLAKKDLNRYFINCQGCIYKPPYSKRRSLAFALRSDNKDTIEVVWEKFETFYKEISKEIEKFNIFSQEFQTFLHLENLRMKLLLRRIQKPIPAEIAFFSLPQEYYDSLPPNVAFLALNQEITPSEYITQFNLYSSFLNGNLILLRRSRSYLRAKFSWVGNSKLIYAAKEARLWKIPNAYWKSDEWKMILDSNVLVFDKAGNVLPAPTLKKVCEREGDLRLFYPLLRQLPHDWCYRNPFVKSVGREKNVIEVNKEGEPKVASALPGSLFRLIGPAPFKSLLDDCFFNPLDKDLRECMLIVDQEISQKVEAQKVEASLESCTYSIAVPIRYHLEEPKVSNQFENVLAIDQGEAGLAYAVFSLKSIGEAETKPIAVGTIRIPSIRRLIHSVSTYRKKKQRLQNFKQNYDSTAFIMRENVTGDVCAKIVGLMKEFNAFPVLEYDVKNLESGSRQLSAVYKAVNSHFLYFKEPGRDALRKQLWYGGDSWTIDGIEIVTRERKEDGKEGVEKIVPLKVFPGRSVSARFTSKTCSCCGRNVFDWLFTEKKAKTNKKFNVNSKGELTTADGVIQLFEADRSKGPKFYARRKERTPLTKPIAKGSYSLEEIERRVRTNLRRAPKSKQSRDTSQSQYFCVYKDCALHFSGMQADENAAINIGRRFLTALRKNRRSDFPSNVKISDRLLDN

SEQ ID NO: 17 - protein, 1218 aa, Artificial Sequence
  Synthetic sequence
MTKHSIPLHAFRNSGADARKWKGRIALLAKRGKETMRTLQFPLEMSEPEAAAINTTPFAVAYNAIEGTGKGTLFDYWAKLHLAGFRFFPSGGAATIFRQQAVFEDASWNAAFCQQSGKDWPWLVPSKLYERFTKAPREVAKKDGSKKSIEFTQENVANESHVSLVGASITDKTPEDQKEFFLKMAGALAEKFDSWKSANEDRIVAMKVIDEFLKSEGLHLPSLENIAVKCSVETKPDNATVAWHDAPMSGVQNLAIGVFATCASRIDNIYDLNGGKLSKLIQESATTPNVTALSWLFGKGLEYFRTTDIDTIMQDFNIPASAKESIKPLVESAQAIPTMTVLGKKNYAPFRPNFGGKIDSWIANYASRLMLLNDILEQIEPGFELPQALLDNETLMSGIDMTGDELKELIEAVYAWVDAAKQGLATLLGRGGNVDDAVQTFEQFSAMMDTLNGTLNTISARYVRAVEMAGKDEARLEKLIECKFDIPKWCKSVPKLVGISGGLPKVEEEIKVMNAAFKDVRARMFVRFEEIAAYVASKGAGMDVYDALEKRELEQIKKLKSAVPERAHIQAYRAVLHRIGRAVQNCSEKTKQLFSSKVIEMGVFKNPSHLNNFIFNQKGAIYRSPFDRSRHAPYQLHADKLLKNDWLELLAEISATLMASESTEQMEDALRLERTRLQLQLSGLPDWEYPASLAKPDIEVEIQTALKMQLAKDTVTSDVLQRAFNLYSSVLSGLTFKLLRRSFSLKMRFSVADTTQLIYVPKVCDWAIPKQYLQAEGEIGIAARVVTESSPAKMVTEVEMKEPKALGHFMQQAPHDWYFDASLGGTQVAGRIVEKGKEVGKERKLVGYRMRGNSAYKTVLDKSLVGNTELSQCSMIIEIPYTQTVDADFRAQVQAGLPKVSINLPVKETITASNKDEQMLFDRFVAIDLGERGLGYAVFDAKTLELQESGHRPIKAITNLLNRTHHYEQRPNQRQKFQAKFNVNLSELRENTVGDVCHQINRICAYYNAFPVLEYMVPDRLDKQLKSVYESVTNRYIWSSTDAHKSARVQFWLGGETWEHPYLKSAKDKKPLVLSPGRGASGKGTSQTCSCCGRNPFDLIKDMKPRAKIAVVDGKAKLENSELKLFERNLESKDDMLARRHRNERAGMEQPLTPGNYTVDEIKALLRANLRRAPKNRRTKDTTVSEYHCVFSDCGKTMHADENAAVNIGGKFIADIEK

SEQ ID NO: 18 - protein, 1252 aa, Artificial Sequence; identical to SEQ ID NO: 13
  Synthetic sequence

SEQ ID NO: 19 - protein, 500 aa, Unknown
  Woesearchaeota
MEVQKTVMKTLSLRILRPLYSQEIEKEIKEEKERRKQAGGTGELDGGFYKKLEKKHSEMFSFDRLNLLLNQLQREIAKVYNHAISELYIATIAQGNKSNKHYISSIVYNRAYGYFYNAYIALGICSKVEANFRSNELLTQQSALPTAKSDNFPIVLHKQKGAEGEDGGFRISTEGSDLIFEIPIPFYEYNGENRKEPYKWVKKGGQKPVLKLILSTFRRQRNKGWAKDEGTDAEIRKVTEGKYQVSQIEINRGKKLGEHQKWFANFSIEQPIYERKPNRSIVGGLDVGIRSPLVCAINNSFSRYSVDSNDVFKFSKQVFAFRRRLLSKNSLKRKGHGAAHKLEPITEMTEKNDKFRKKIIERWAKEVTNFFVKNQVGIVQIEDLSTMKDREDHFFNQYLRGFWPYYQMQTLIENKLKEYGIEVKRVQAKYTSQLCSNPNCRYWNNYFNFEYRKVNKFPKFKCEKCNLEISADYNAARNLSTPDIEKFVAKATKGINLPEK

SEQ ID NO: 20 - protein, 507 aa, Unknown
  Synthetic sequence
MEEAKTVSKTLSLRILRPLYSAEIEKEIKEEKERRKQGGKSGELDSGFYKKLEKKHTQMFGWDKLNLMLSQLQRQIARVFNQSISELYIETVIQGKKSNKHYTSKIVYNRAYSVFYNAYLALGITSKVEANFRSTELLMQKSSLPTAKSDNFPILLHKQKGVEGEEGGFKISADGNDLIFEIPIPFYEYDSANKKEPFKWIKKGGQKPTIKLILSTFRRQRNKGWAKDEGTDAEIRKVIEGKYQVSHIEINRGKKLGDHQKWFVNFTIEQPIYERKLDKNIIGGIDVGIKSPLVCAVNNSFARYSVDSNDVLKFSKQAFAFRRRLLSKNSLKRSGHGSKNKLDPITRMTEKNDRFRKKIIERWAKEVTNFFIKNQVGTVQIEDLSTMKDRQDNFFNQYLRGFWPYYQMQNLIENKLKEYGIETKRIKARYTSQLCSNPSCRHWNSYFSFDHRKTNNFPKFKCEKCALEISADYNAARNISTPDIEKFVAKATKGINLPDKNENVILE

SEQ ID NO: 21 - protein, 529 aa, Unknown
  Synthetic sequence
MAKNTITKTLKLRIVRPYNSAEVEKIVADEKNNREKIALEKNKDKVKEACSKHLKVAAYCTTQVERNACLFCKARKLDDKFYQKLRGQFPDAVFWQEISEIFRQLQKQAAEIYNQSLIELYYEIFIKGKGIANASSVEHYLSDVCYTRAAELFKNAAIASGLRSKIKSNFRLKELKNMKSGLPTTKSDNFPIPLVKQKGGQYTGFEISNHNSDFIIKIPFGRWQVKKEIDKYRPWEKFDFEQVQKSPKPISLLLSTQRRKRNKGWSKDEGTEAEIKKVMNGDYQTSYIEVKRGSKIGEKSAWMLNLSIDVPKIDKGVDPSIIGGIDVGVKSPLVCAINNAFSRYSISDNDLFHFNKKMFARRRILLKKNRHKRAGHGAKNKLKPITILTEKSERFRKKLIERWACEIADFFIKNKVGTVQMENLESMKRKEDSYFNIRLRGFWPYAEMQNKIEFKLKQYGIEIRKVAPNNTSKTCSKCGHLNNYFNFEYRKKNKFPHFKCEKCNFKENADYNAALNISNPKLKSTKEEP

SEQ ID NO: 22 - protein, 726 aa, Unknown
  Synthetic sequence
MERQKVPQIRKIVRVVPLRILRPKYSDVIENALKKFKEKGDDTNTNDFWRAIRDRDTEFFRKELNFSEDEINQLERDTLFRVGLDNRVLFSYFDFLQEKLMKDYNKIISKLFINRQSKSSFENDLTDEEVEELIEKDVTPFYGAYIGKGIKSVIKSNLGGKFIKSVKIDRETKKVTKLTAINIGLMGLPVAKSDTFPIKIIKTNPDYITFQKSTKENLQKIEDYETGIEYGDLLVQITIPWFKNENKDFSLIKTKEAIEYYKLNGVGKKDLLNINLVLTTYHIRKKKSWQIDGSSQSLVREMANGELEEKWKSFFDTFIKKYGDEGKSALVKRRVNKKSRAKGEKGRELNLDERIKRLYDSIKAKSFPSEINLIPENYKWKLHFSIEIPPMVNDIDSNLYGGIDFGEQNIATLCVKNIEKDDYDFLTIYGNDLLKHAQASYARRRIMRVQDEYKARGHGKSRKTKAQEDYSERMQKLRQKITERLVKQISDFFLWRNKFHMAVCSLRYEDLNTLYKGESVKAKRMRQFINKQQLFNGIERKLKDYNSEIYVNSRYPHYTSRLCSKCGKLNLYFDFLKFRTKNIIIRKNPDGSEIKYMPFFICEFCGWKQAGDKNASANIADKDYQDKLNKEKEFCNIRKPKSKKEDIGEENEEERDYSRRFNRNSFIYNSLKKDNKLNQEKLFDEWKNQLKRKIDGRNKFEPKEYKDRFSYLFAYYQEIIKNESES

SEQ ID NO: 23 - protein, 517 aa, Unknown
  Synthetic sequence
MVPTELITKTLQLRVIRPLYFEEIEKELAELKEQKEKEFEETNSLLLESKKIDAKSLKKLKRKARSSAAVEFWKIAKEKYPDILTKPEMEFIFSEMQKMMARFYNKSMTNIFIEMNNDEKVNPLSLISKASTEANQVIKCSSISSGLNRKIAGSINKTKFKQVRDGLISLPTARTETFPISFYKSTANKDEIPISKINLPSEEEADLTITLPFPFFEIKKEKKGQKAYSYFNIIEKSGRSNNKIDLLLSTHRRQRRKGWKEEGGTSAEIRRLMEGEFDKEWEIYLGEAEKSEKAKNDLIKNMTRGKLSKDIKEQLEDIQVKYFSDNNVESWNDLSKEQKQELSKLRKKKVEELKDWKHVKEILKTRAKIGWVELKRGKRQRDRNKWFVNITITRPPFINKELDDTKFGGIDLGVKVPFVCAVHGSPARLIIKENEILQFNKMVSARNRQITKDSEQRKGRGKKNKFIKKEIFNERNELFRKKIIERWANQIVKFFEDQKCATVQIENLESFDRTSYK

SEQ ID NO: 24 - protein, 481 aa, Unknown
  Synthetic sequence
MKSDTKDKKIIIHQTKTLSLRIVKPQSIPMEEFTDLVRYHQMIIFPVYNNGAIDLYKKLFKAKIQKGNEARAIKYFMNKIVYAPIANTVKNSYIALGYSTKMQSSFSGKRLWDLRFGEATPPTIKADFPLPFYNQSGFKVSSENGEFIIGIPFGQYTKKTVSDIEKKTSFAWDKFTLEDTTKKTLIELLLSTKTRKMNEGWKNNEGTEAEIKRVMDGTYQVTSLEILQRDDSWFVNFNIAYDSLKKQPDRDKIAGIHMGITRPLTAVIYNNKYRALSIYPNTVMHLTQKQLARIKEQRTNSKYATGGHGRNAKVTGTDTLSEAYRQRRKKIIEDWIASIVKFAINNEIGTIYLEDISNTNSFFAAREQKLIYLEDISNTNSFLSTYKYPISAISDTLQHKLEEKAIQVIRKKAYYVNQICSLCGHYNKGFTYQFRRKNKFPKMKCQGCLEATSTEFNAAANVANPDYEKLLIKHGLLQLKK

SEQ ID NO: 25 - protein, 358 aa, Unknown
  Synthetic sequence
MSTITRQVRLSPTPEQSRLLMAHCQQYISTVNVLVAAFDSEVLTGKVSTKDFRAALPSAVKNQALRDAQSVFKRSVELGCLPVLKKPHCQWNNQNWRVEGDQLILPICKDGKTQQERFRCAAVALEGKAGILRIKKKRGKWIADLTVTQEDAPESSGSAIMGVDLGIKVPAVAHIGGKGTRFFGNGRSQRSMRRRFYARRKTLQKAKKLRAVRKSKGKEARWMKTINHQLSRQIVNHAHALGVGTIKIEALQGIRKGTTRKSRGAAARKNNRMTNTWSFSQLTLFITYKAQRQGITVEQVDPAYTSQDCPACRARNGAQDRTYVCSECGWRGHRDTVGAINISRRAGLSGHRRGATGA

SEQ ID NO: 26 - protein, 507 aa, Unknown
  Micrarchaeota
MIAQKTIKIKLNPTKEQIIKLNSIIEEYIKVSNFTAKKIAEIQESFTDSGLTQGTCSECGKEKTYRKYHLLKKDNKLFCITCYKRKYSQFTLQKVEFQNKTGLRNVAKLPKTYYTNAIRFASDTFSGFDEIIKKKQNRLNSIQNRLNFWKELLYNPSNRNEIKIKVVKYAPKTDTREHPHYYSEAEIKGRIKRLEKQLKKFKMPKYPEFTSETISLQRELYSWKNPDELKISSITDKNESMNYYGKEYLKRYIDLINSQTPQILLEKENNSFYLCFPITKNIEMPKIDDTFEPVGIDWGITRNIAVVSILDSKTKKPKFVKFYSAGYILGKRKHYKSLRKHFGQKKRQDKINKLGTKEDRFIDSNIHKLAFLIVKEIRNHSNKPIILMENITDNREEAEKSMRQNILLHSVKSRLQNYIAYKALWNNIPTNLVKPEHTSQICNRCGHQDRENRPKGSKLFKCVKCNYMSNADFNASINIARKFYIGEYEPFYKDNEKMKSGVNSISM

SEQ ID NO: 27 - protein, 534 aa, Unknown
  Synthetic sequence
LKLSEQENITTGVKFKLKLDKETSEGLNDYFDEYGKAINFAIKVIQKELAEDRFAGKVRLDENKKPLLNEDGKKIWDFPNEFCSCGKQVNRYVNGKSLCQECYKNKFTEYGIRKRMYSAKGRKAEQDINIKNSTNKISKTHFNYAIREAFILDKSIKKQRKERFRRLREMKKKLQEFIEIRDGNKILCPKIEKQRVERYIHPSWINKEKKLEDFRGYSMSNVLGKIKILDRNIKREEKSLKEKGQINFKARRLMLDKSVKFLNDNKISFTISKNLPKEYELDLPEKEKRLNWLKEKIKIIKNQKPKYAYLLRKDDNFYLQYTLETEFNLKEDYSGIVGIDRGVSHIAVYTFVHNNGKNERPLFLNSSEILRLKNLQKERDRFLRRKHNKKRKKSNMRNIEKKIQLILHNYSKQIVDFAKNKNAFIVFEKLEKPKKNRSKMSKKSQYKLSQFTFKKLSDLVDYKAKREGIKVLYISPEYTSKECSHCGEKVNTQRPFNGNSSLFKCNKCGVELNADYNASINIAKKGLNILNSTN

SEQ ID NO: 28 - DNA, 43 bp, Artificial Sequence
  Synthetic sequence
ctccgaaagtatcggggataaaggcatcaataccaaactctgg

SEQ ID NO: 29 - protein, 411 aa, Artificial Sequence
  Synthetic sequence
EHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKVLIDKLNCLVLKDYPAEKVGGVLNPYQLTDQFTSFAKMGTQSGFLFYVPAPYTSKIDPLTGFVDPFVQKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNISNAATGEDYINSPVRDLNGVCFDSRFQNPEWPMDADANGAYHIALKGQLLLNHLKESKDLKLQNGISNQDQLAYIQELRN

SEQ ID NO: 30 - protein, 406 aa, Artificial Sequence
  Synthetic sequence
HDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKVLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFAAAKKNNVFAQEEVCLTSAYKELFNKYGINYQQGDIRALLCEQSDKAFYSSFMALMSLMLQMRNISTGRTDVDFLISPVKNSDGIFYDSRNYEAQENAILPKNADANGAYNIARKVLWAIGQFKKAEDEKLDKVKIAISNKEWLEYAQTSVK

SEQ ID NO: 31 - DNA, 25 bp, Artificial Sequence
  Synthetic sequence
ctccgaaagtatcggggataaaggc

SEQ ID NO: 32 - DNA, 25 bp, Artificial Sequence
  Synthetic sequence
caccgaaatttggagaggataaggc

SEQ ID NO: 33 - DNA, 25 bp, Artificial Sequence
  Synthetic sequence
ctccgaattatcgggaggataaggc

SEQ ID NO: 34 - DNA, 25 bp, Artificial Sequence
  Synthetic sequence
ccccgaatataggggacaaaaaggc

SEQ ID NO: 35 - protein, 537 aa, Unknown
  Synthetic sequence
MEESIITGVKFKLRIDKETTKKLNEYFDEYGKAINFAVKIIQKELADDRFAGKAKLDQNKNPILDENGKKIYEFPDEFCSCGKQVNKYVNNKPFCQECYKIRFTENGIRKRMYSAKGRKAEHKINILNSTNKISKTHFNYAIREAFILDKSIKKQRKKRNERLRESKKRLQQFIDMRDGKREICPTIKGQKVDRFIHPSWITKDKKLEDFRGYTLSIINSKIKILDRNIKREEKSLKEKGQIIFKAKRLMLDKSIRFVGDRKVLFTISKTLPKEYELDLPSKEKRLNWLKEKIEIIKNQKPKYAYLLRKNIESEKKPNYEYYLQYTLEIKPELKDFYDGAIGIDRGINHIAVCTFISNDGKVTPPKFFSSGEILRLKNLQKERDRFLLRKHNKNRKKGNMRVIENKINLILHRYSKQIVDMAKKLNASIVFEELGRIGKSRTKMKKSQRYKLSLFIFKKLSDLVDYKSRREGIRVTYVPPEYTSKECSHCGEKVNTQRPFNGNYSLFKCNKCGIQLNSDYNASINIAKKGLKIPNST

SEQ ID NO: 36 - protein, 541 aa, Unknown
  Synthetic sequence
LWTIVIGDFIEMPKQDLVTTGIKFKLDVDKETRKKLDDYFDEYGKAINFAVKIIQKNLKEDRFAGKIALGEDKKPLLDKDGKKIYNYPNESCSCGNQVRRYVNAKPFCVDCYKLKFTENGIRKRMYSARGRKADSDINIKNSTNKISKTHFNYAIREGFILDKSLKKQRSKRIKKLLELKRKLQEFIDIRQGQMVLCPKIKNQRVDKFIHPSWLKRDKKLEEFRGYSLSVVEGKIKIFNRNILREEDSLRQRGHVNFKANRIMLDKSVRFLDGGKVNFNLNKGLPKEYLLDLPKKENKLSWLNEKISLIKLQKPKYAYLLRREGSFFIQYTIENVPKTFSDYLGAIGIDRGISHIAVCTFVSKNGVNKAPVFFSSGEILKLKSLQKQRDLFLRGKHNKIRKKSNMRNIDNKINLILHKYSRNIVNLAKSEKAFIVFEKLEKIKKSRFKMSKSLQYKLSQFTFKKLSDLVEYKAKIEGIKVDYVPPEYTSKECSHCGEKVDTQRPFNGNSSLFKCNKCRVQLNADYNASINIAKKSLNISNN

SEQ ID NO: 37 - protein, 542 aa, Unknown
  Micrarchaeota
MSKTTISVKLKIIDLSSEKKEFLDNYFNEYAKATTFCQLRIRRLLRNTHWLGKKEKSSKKWIFESGICDLCGENKELVNEDRNSGEPAKICKRCYNGRYGNQMIRKLFVSTKKREVQENMDIRRVAKLNNTHYHRIPEEAFDMIKAADTAEKRRKKNVEYDKKRQMEFIEMFNDEKKRAARPKKPNERETRYVHISKLESPSKGYTLNGIKRKIDGMGKKIERAEKGLSRKKIFGYQGNRIKLDSNWVRFDLAESEITIPSLFKEMKLRITGPTNVHSKSGQIYFAEWFERINKQPNNYCYLIRKTSSNGKYEYYLQYTYEAEVEANKEYAGCLGVDIGCSKLAAAVYYDSKNKKAQKPIEIFTNPIKKIKMRREKLIKLLSRVKVRHRRRKLMQLSKTEPIIDYTCHKTARKIVEMANTAKAFISMENLETGIKQKQQARETKKQKFYRNMFLFRKLSKLIEYKALLKGIKIVYVKPDYTSQTCSSCGADKEKTERPSQAIFRCLNPTCRYYQRDINADFNAAVNIAKKALNNTEVVTTLL

SEQ ID NO: 38 - protein, 564 aa, Unknown
  Synthetic sequence
MARAKNQPYQKLTTTTGIKFKLDLSEEEGKRFDEYFSEYAKAVNFCAKVIYQLRKNLKFAGKKELAAKEWKFEISNCDFCNKQKEIYYKNIANGQKVCKGCHRTNFSDNAIRKKMIPVKGRKVESKFNIHNTTKKISGTHRHWAFEDAADIIESMDKQRKEKQKRLRREKRKLSYFFELFGDPAKRYELPKVGKQRVPRYLHKIIDKDSLTKKRGYSLSYIKNKIKISERNIERDEKSLRKASPIAFGARKIKMSKLDPKRAFDLENNVFKIPGKVIKGQYKFFGTNVANEHGKKFYKDRISKILAGKPKYFYLLRKKVAESDGNPIFEYYVQWSIDTETPAITSYDNILGIDAGITNLATTVLIPKNLSAEHCSHCGNNHVKPIFTKFFSGKELKAIKIKSRKQKYFLRGKHNKLVKIKRIRPIEQKVDGYCHVVSKQIVEMAKERNSCIALEKLEKPKKSKFRQRRREKYAVSMFVFKKLATFIKYKAAREGIEIIPVEPEGTSYTCSHCKNAQNNQRPYFKPNSKKSWTSMFKCGKCGIELNSDYNAAFNIAQKALNMTSA

SEQ ID NO: 39 - protein, 610 aa, Unknown
  Synthetic sequence
MDEKHFFCSYCNKELKISKNLINKISKGSIREDEAVSKAISIHNKKEHSLILGIKFKLFIENKLDKKKLNEYFDNYSKAVTFAARIFDKIRSPYKFIGLKDKNTKKWTFPKAKCVFCLEEKEVAYANEKDNSKICTECYLKEFGENGIRKKIYSTRGRKVEPKYNIFNSTKELSSTHYNYAIRDAFQLLDALKKQRQKKLKSIFNQKLRLKEFEDIFSDPQKRIELSLKPHQREKRYIHLSKSGQESINRGYTLRFVRGKIKSLTRNIEREEKSLRKKTPIHFKGNRLMIFPAGIKFDFASNKVKISISKNLPNEFNFSGTNVKNEHGKSFFKSRIELIKTQKPKYAYVLRKIKREYSKLRNYEIEKIRLENPNADLCDFYLQYTIETESRNNEEINGIIGIDRGITNLACLVLLKKGDKKPSGVKFYKGNKILGMKIAYRKHLYLLKGKRNKLRKQRQIRAIEPKINLILHQISKDIVKIAKEKNFAIALEQLEKPKKARFAQRKKEKYKLALFTFKNLSTLIEYKSKREGIPVIYVPPEKTSQMCSHCAINGDEHVDTQRPYKKPNAQKPSYSLFKCNKCGIELNADYNAAFNIAQKGLKTLMLNHSH

SEQ ID NO: 40 - protein, 369 aa, Unknown
  Synthetic sequence
MLQTLLVKLDPSKEQYKMLYETMERFNEACNQIAETVFAIHSANKIEVQKTVYYPIREKFGLSAQLTILAIRKVCEAYKRDKSIKPEFRLDGALVYDQRVLSWKGLDKVSLVTLQGRQIIPIKFGDYQKARMDRIRGQADLILVKGVFYLCVVVEVSEESPYDPKGVLGVDLGIKNLAVDSDGEVHSGEQTTNTRERLDSLKARLQSKGTKSAKRHLKKLSGRMAKFSKDVNHCISKKLVAKAKGTLMSIALEDLQGIRDRVTVRKAQRRNLHTWNFGLLRMFVDYKAKIAGVPLVFVDPRNTSRTCPSCGHVAKANRPTRDEFRCVSCGFAGAADHIAAMNIAFRAEVSQPIVTRFFVQSQAPSFRVG

SEQ ID NO: 41 - RNA, 76 nt, Artificial Sequence
  Synthetic sequence
cuccgaaaguaucaaaauaaaaaggguuuccaguuuuuaacuaaacuuuagccuuccacccuuuccugauuuuguu

SEQ ID NO: 42 - RNA, 79 nt, Artificial Sequence
  Synthetic sequence
accugccaaaauuucguucaacgaaacuuaagcaggcaagaaaauuuaaaauuaaauccgcuggugggcggauaaaguc

SEQ ID NO: 43 - RNA, 51 nt, Artificial Sequence
  Synthetic sequence
gguauuuccggacagcggcuugaccgcaucguccucgccuuuuccuaaaau

SEQ ID NO: 44 - protein, 552 aa, Unknown
  Synthetic sequence
MDEEPDSAEPNLAPISVKLKLVKLDGEKLAALNDYFNEYAKAVNFCELKMQKIRKNLVNIRGTYLKEKKAWINQTGECCICKKIDELRCEDKNPDINGKICKKCYNGRYGNQMIRKLFVSTNKRAVPKSLDIRKVARLHNTHYHRIPPEAADIIKAIETAERKRRNRILFDERRYNELKDALENEEKRVARPKKPKEREVRYVPISKKDTPSKGYTMNALVRKVSGMAKKIERAKRNLNKRKKIEYLGRRILLDKNWVRFDFDKSEISIPTMKEFFGEMRFEITGPSNVMSPNGREYFTKWFDRIKAQPDNYCYLLRKESEDETDFYLQYTWRPDAHPKKDYTGCLGIDIGGSKLASAVYFDADKNRAKQPIQIFSNPIGKWKTKRQKVIKVLSKAAVRHKTKKLESLRNIEPRIDVHCHRIARKIVGMALAANAFISMENLEGGIREKQKAKETKKQKFSRNMFVFRKLSKLIEYKALMEGVKVVYIVPDYTSQLCSSCGTNNTKRPKQAIFMCQNTECRYFGKNINADFNAAINIAKKALNRKDIVRELS

SEQ ID NO: 45 - protein, 534 aa, Unknown
  Synthetic sequence
MEKNNSEQTSITTGIKFKLKLDKETKEKLNNYFDEYGKAINFAVRIIQMQLNDDRLAGKYKRDEKGKPILGEDGKKILEIPNDFCSCGNQVNHYVNGVSFCQECYKKRFSENGIRKRMYSAKGRKAEQDINIKNSTNKISKTHFNYAIREAFNLDKSIKKQREKRFKKLKDMKRKLQEFLEIRDGKRVICPKIEKQKVERYIHPSWINKEKKLEEFRGYSLSIVNSKIKSFDRNIQREEKSLKEKGQINFKAQRLMLDKSVKFLKDNKVSFTISKELPKTFELDLPKKEKKLNWLNEKLEIIKNQKPKYAYLLRKENNIFLQYTLDSIPEIHSEYSGAVGIDRGVSHIAVYTFLDKDGKNERPFFLSSSGILRLKNLQKERDKFLRKKHNKIRKKGNMRNIEQKINLILHEYSKQIVNFAKDKNAFIVFELLEKPKKSRERMSKKIQYKLSQFTFKKLSDLVDYKAKREGIKVIYVEPAYTSKDCSHCGERVNTQRPFNGNFSLFKCNKCGIVLNSDYNASLNIARKGLNISAN

SEQ ID NO: 46 - protein, 577 aa, Unknown
  Synthetic sequence
MAEEKFFFCEKCNKDIKIPKNYINKQGAEEKARAKHEHRVHALILGIKFKIYPKKEDISKLNDYFDEYAKAVTFTAKIVDKLKAPFLFAGKRDKDTSKKKWVFPVDKCSFCKEKTEINYRTKQGKNICNSCYLTEFGEQGLLEKIYATKGRKVSSSFNLFNSTKKLTGTHNNYVVKESLQLLDALKKQRSKRLKKLSNTRRKLKQFEEMFEKEDKRFQLPLKEKQRELRFIHVSQKDRATEFKGYTMNKIKSKIKVLRRNIEREQRSLNRKSPVFFRGTRIRLSPSVQFDDKDNKIKLTLSKELPKEYSFSGLNVANEHGRKFFAEKLKLIKENKSKYAYLLRRQVNKNNKKPIYDYYLQYTVEFLPNIITNYNGILGIDRGINTLACIVLLENKKEKPSFVKFFSGKGILNLKNKRRKQLYFLKGVHNKYRKQQKIRPIEPRIDQILHDISKQIIDLAKEKRVAISLEQLEKPQKPKFRQSRKAKYKLSQFNFKTLSNYIDYKAKKEGIRVIYIAPEMTSQNCSRCAMKNDLHVNTQRPYKNTSSLFKCNKCGVELNADYNAAFNIAQKGLKILNS

SEQ ID NO: 47 - protein, 613 aa, Unknown
  Synthetic sequence
MISLKLKLLPDEEQKKLLDEMFWKWASICTRVGFGRADKEDLKPPKDAEGVWFSLTQLNQANTDINDLREAMKHQKHRLEYEKNRLEAQRDDTQDALKNPDRREISTKRKDLFRPKASVEKGFLKLKYHQERYWVRRLKEINKLIERKTKTLIKIEKGRIKFKATRITLHQGSFKIRFGDKPAFLIKALSGKNQIDAPFVVVPEQPICGSVVNSKKYLDEITTNFLAYSVNAMLFGLSRSEEMLLKAKRPEKIKKKEEKLAKKQSAFENKKKELQKLLGRELTQQEEAIIEETRNQFFQDFEVKITKQYSELLSKIANELKQKNDFLKVNKYPILLRKPLKKAKSKKINNLSPSEWKYYLQFGVKPLLKQKSRRKSRNVLGIDRGLKHLLAVTVLEPDKKTFVWNKLYPNPITGWKWRRRKLLRSLKRLKRRIKSQKHETIHENQTRKKLKSLQGRIDDLLHNISRKIVETAKEYDAVIVVEDLQSMRQHGRSKGNRLKTLNYALSLFDYANVMQLIKYKAGIEGIQIYDVKPAGTSQNCAYCLLAQRDSHEYKRSQENSKIGVCLNPNCQNHKKQIDADLNAARVIASCYALKINDSQPFGTRKRFKKRTTN

SEQ ID NO: 48 - protein, 615 aa, Unknown
  Synthetic sequence
METLSLKLKLNPSKEQLLVLDKMFWKWASICTRLGLKKAEMSDLEPPKDAEGVWFSKTQLNQANTDVNDLRKAMQHQGKRIEYELDKVENRRNEIQEMLEKPDRRDISPNRKDLFRPKAAVEKGYLKLKYHKLGYWSKELKTANKLIERKRKTLAKIDAGKMKFKPTRISLHTNSFRIKFGEEPKIALSTTSKHEKIELPLITSLQRPLKTSCAKKSKTYLDAAILNFLAYSTNAALFGLSRSEEMLLKAKKPEKIEKRDRKLATKRESFDKKLKTLEKLLERKLSEKEKSVFKRKQTEFFDKFCITLDETYVEALHRIAEELVSKNKYLEIKKYPVLLRKPESRLRSKKLKNLKPEDWTYYIQFGFQPLLDTPKPIKTKTVLGIDRGVRHLLAVSIFDPRTKTFTFNRLYSNPIVDWKWRRRKLLRSIKRLKRRLKSEKHVHLHENQFKAKLRSLEGRIEDHFHNLSKEIVDLAKENNSVIVVENLGGMRQHGRGRGKWLKALNYALSHFDYAKVMQLIKYKAELAGVFVYDVAPAGTSINCAYCLLNDKDASNYTRGKVINGKKNTKIGECKTCKKEFDADLNAARVIALCYEKRLNDPQPFGTRKQFKPKKP

SEQ ID NO: 49 - protein, 775 aa, Unknown
  Synthetic sequence
MKALKLQLIPTRKQYKILDEMFWKWASLANRVSQKGESKETLAPKKDIQKIQFNATQLNQIEKDIKDLRGAMKEQQKQKERLLLQIQERRSTISEMLNDDNNKERDPHRPLNFRPKGWRKFHTSKHWVGELSKILRQEDRVKKTIERIVAGKISFKPKRIGIWSSNYKINFFKRKISINPLNSKGFELTLMTEPTQDLIGKNGGKSVLNNKRYLDDSIKSLLMFALHSRFFGLNNTDTYLLGGKINPSLVKYYKKNQDMGEFGREIVEKFERKLKQEINEQQKKIIMSQIKEQYSNRDSAFNKDYLGLINEFSEVFNQRKSERAEYLLDSFEDKIKQIKQEIGESLNISDWDFLIDEAKKAYGYEEGFTEYVYSKRYLEILNKIVKAVLITDIYFDLRKYPILLRKPLDKIKKISNLKPDEWSYYIQFGYDSINPVQLMSTDKFLGIDRGLTHLLAYSVFDKEKKEFIINQLEPNPIMGWKWKLRKVKRSLQHLERRIRAQKMVKLPENQMKKKLKSIEPKIEVHYHNISRKIVNLAKDYNASIVVESLEGGGLKQHGRKKNARNRSLNYALSLFDYGKIASLIKYKADLEGVPMYEVLPAYTSQQCAKCVLEKGSFVDPEIIGYVEDIGIKGSLLDSLFEGTELSSIQVLKKIKNKIELSARDNHNKEINLILKYNFKGLVIVRGQDKEEIAEHPIKEINGKFAILDFVYKRGKEKVGKKGNQKVRYTGNKKVGYCSKHGQVDADLNASRVIALCKYLDINDPILFGEQRKSFK

SEQ ID NO: 50 - protein, 777 aa, Unknown
  Synthetic sequence
MVTRAIKLKLDPTKNQYKLLNEMFWKWASLANRFSQKGASKETLAPKDGTQKIQFNATQLNQIKKDVDDLRGAMEKQGKQKERLLIQIQERLLTISEILRDDSKKEKDPHRPQNFRPFGWRRFHTSAYWSSEASKLTRQVDRVRRTIERIKAGKINFKPKRIGLWSSTYKINFLKKKINISPLKSKSFELDLITEPQQKIIGKEGGKSVANSKKYLDDSIKSLLIFAIKSRLFGLNNKDKPLFENIITPNLVRYHKKGQEQENFKKEVIKKFENKLKKEISQKQKEIIFSQIERQYENRDATFSEDYLRAISEFSEIFNQRKKERAKELLNSFNEKIRQLKKEVNGNISEEDLKILEVEAEKAYNYENGFIEWEYSEQFLGVLEKIARAVLISDNYFDLKKYPILIRKPTNKSKKITNLKPEEWDYYIQFGYGLINSPMKIETKNFMGIDRGLTHLLAYSIFDRDSEKFTINQLELNPIKGWKWKLRKVKRSLQHLERRMRAQKGVKLPENQMKKRLKSIEPKIESYYHNLSRKIVNLAKANNASIVVESLEGGGLKQHGRKKNSRHRALNYALSLFDYGKIASLIKYKSDLEGVPMYEVLPAYTSQQCAKCVLKKGSFVEPEIIGYIEEIGFKENLLTLLFEDTGLSSVQVLKKSKNKMTLSARDKEGKMVDLVLKYNFKGLVISQEKKKEEIVEFPIKEIDGKFAVLDSAYKRGKERISKKGNQKLVYTGNKKVGYCSVHGQVDADLNASRVIALCKYLGINEPIVFGEQRKSFK

SEQ ID NO: 51 - protein, 1224 aa, Artificial Sequence
  Synthetic sequence
MDKKITGYRLHFKRILFSGGEIVRTIKFPLSSTSLSSGKNDLINNFEGQLINDDLKIRGDVNLNDYLIYEFSGKPIYTLFNFWIDSLKSGIIWADKPASLIDFINEFYLIKSPYDLVWERATEEFKKYFDKKSFKEILISGPIRKTKNPSKKESFKKKDNKLPDEYVIKEGNSLSVESPEVLKFINKIVSSFFDEDGNLILEGKKQDNFWLNEFGIDKSIIQKTKPEGELKDITFVIIPELIVDSFNKEYEVDSLIEKRRVWLKKRFNKEKEIEKNLQLILGLSNNFNGFSNFLGKGLRAFQGGKILMIFEAMSKINPSIKNQENKEKVLEALNFLSDKSKFFPLRPSLNIVKSWADYRTFFGGKLQSWYSNGIRRKNELKVQVKEIYEFLTKAQDYLAAKISFNDENKRYARKELESINLKINRLKQFIENENFDISSEDRYLIFDTLLSSLRTQLNLYYQKYLSSEEDNIRENKDLKGIYQKIYKPIAFFGKATKRKNKKVIEETVPIIESGINNLFSLMKKLEKTFLPKNTFSKVKNKNEDEETNLRNLVDYYQNKVSHKMLNSLTFVNKLEEVMKSVIEENDWDKLHSNKYVFYKSEYQKGALELIPLKKGSWIDIFEKIILEMTSYLLTFDLTDLLKDKKILLDWIEIAKNTLAKLIKFNTCDVFTLDELNLDLRNFPKAMDYIKIFKITKVDKNELNFIVQSFILSELKGAATLFSKEKYLAKYNVQVINADKKFKLFYKPNDGFIEREVDRKNLLKPHQYFVALDKIEDKKIKEKANFLLITKEDIKPVFIKEENFSKLYKISSSFYQIQFLDKFIYMPEEFKDLGIRLSEWNFVLEREYKIDWDLCTKRPKMTFIENSKKNKLYLSIPFNVFYKSKKKDVSLSKVISNRLSYPILGIDVGEYGLAYLLAEFSDKKIKILKKGFIEDRNIANIKDKFAEIQLKARTGIFNEEDTTIARVRENAIGNLRNKVHYILTSDRGASIIYERSISNFETGSGRTTKIYDSVKRADTEFETEADKFIHNHVWGKNTKYVGRSLSAYGSSYICSKCHRSIYQFKKEDLREIKLLMREGNILTFLTPIGKVWGYSKDEKFKKDYQFKPTEKDFKEFIKILKDFARPPVGKNKTEVLEKFFLKDNDKKAKIDEFRKKRGASAIFICPFCGFIADADIQAAFVMAVRGYIRFKESQIKEENKSLILEKTINYLKEVQFKPEDIFLPF

SEQ ID NO: 52 - protein, 1154 aa, Artificial Sequence
  Synthetic sequence
MKDSKINAPININANNVSKNKTPKKKPRRKSGKRGYRLHDERIAYSGGTGSCRSIKYELLNPDATRKNLLRGSGLQHEIISAVRQDNLLLYGPLNFNDYIFDKDAPNLLHFWTLALSLGFVFSNQNSIEREFKDYLGVSTEEAVLFGKLNETLKAVFDEAKFISGFLYRNFRGLASKTREQRIKLLTDTLREPLDGVNGDSVSEIIKPYAEKWAEYDGECDQFVFKCELFSIKSTDKPRENTRLSFAIDPAFEVMKLDDKTVFFDDLITHYKENCSDEAQAKRFLGIGDNGNYFNGIFGGLFELLTDGDEKICETTDHLARIYGFDETKKTEINKRLVRLAEYARQINRRPCLVKRWSEYRSDFNGTIESWYSNRQSKQNDTLKQLDEKLKLLEEMRASFPTDSDLCGIKSLSETIEFIRSLKGERIARKVTDELESYLAVLGSELNQYTQQNKDHALPLGWQKKLSKHIQSSPLFFGENKIALWEKLINLKELIKTEVKELEVVLAEDFDDYEITDKQVDNLAALAGRFSESPDGSGHPLVTERLAKIESTLGVDFTHKNNRAKFYLSGFERGKFGKLDVPNKIKVSHLFELADLSILYNAVANSPEDGYILRDTAQLSKIILSAKLRDADREKQRKTVLAHSTLQGYSALISKREFVSRYPLQAVNGSQNLMAYDANRKYYYAYNSEKFAGTKELTVALRGNNFGPEAFGGKFKKVPALRVQSSKYQIQFLDWFFEKQKKRKTELGAGGSFTIAEISCKVNWDDKTPVIFEKPDPRLFVSQPFTINPPENSAKKDYARYIGIDIGEYGLAWHLVEVFEDANEDIGGAGKNAVRIKSVEKGFFTDPQQISLKEDVKKLRENQVRATFTSPDTKIARVRESLIGSYRNLLEDLAVRKDARLCFEYEVSGFESGGARISKVYDSIKRSSVAKKENKAENKQSWGKLFGPEFSFKAIEITAAGTSQYCTKCKRWASLAIKDNNNYQLLEWDNGETGDKRGSDGLLAVTLDGEGKETNRTVRLFPKDGKKAGDTIKGKDLKSAIYRAMRPNMRPSEDGSISLGAGMEAVRRDLMPEQWEKLTLEFGQGKPRGNMAIYVCPYCGHISDADMQAAFNIAVRGYLANRDKEKKVKLGKEYLTDEQSKLTFDPVGILEHTT

SEQ ID NO: 53 - protein, 1184 aa, Artificial Sequence
  Synthetic sequence
MFNQKKGYRLHLERIIYSGGEITRSIKYLLASHSDSQKNKELLNNFSQDLYNDDLKIRGCLNLNDLVNNNQIYNLADFWIDSLRAGVIWQSSASSLIDFIKRLNHQETIGEKIFNNANERIKRFFNSEKFIKEIILSEPKRISSKKQAFYNSLFDILKDEFKKQEKNEKIIIDNKAEQLIKEIVDAFYSNDGVFLMEGEEKQNNFWQEKFNIDKNMIKKEKEDILKDVGDITAFIHPPLIILKGDVSQLIDERKKYFSEKDLEEILGLSDNFNAFSHYFNKFFLLLYQDKQEKIFECYQKIFSFSQEDRKRIKDALDFLLEKSKLLGLPKIVNSWSDYRSVFGGKIKSWFSNYLNREDKAKKQEKKIKEGLEKVNKFLLDFIQKNQVDSDLQQEIKFYYDKLNQFINSYQNQEFFHQQELFLLFSDLLAEYREKLNRFYQKYLSDKEKEEKKVDEFPLFKDLFEKYEGPISFYGKTKLEDNKKIIDLTFKTIKVGLNLIRRLLIDLYNSSDFKNSDNNNQERDLRRIFEFLLNKIPATKTFREKYLSILKDNFDQQTYKEMTLKPSRYTFVENIYSRENRKLIELPSKNFEELLSKIIKDLTDFSLSFKNDDLFVDIYLLSDLVELAKTLISLVINYSNKSQFDSYKNELIDDTYQKAKKYLETFKISFFNSKKEANYFYQTRVLSELKGAVALFSKKYYQAKYNIQILKSNEIFPLFVKFSDLLKKEEINDINKLKLIFKKPYRYLIALKKIKFKKKQQQSSVIHLDKKNKDLVLISPQDEDFLFKLTSSFYQLQFLDRFVYPVKKWLNVDITLSEWSFILEKKYKINWDFNNGKPEFSEIDSRLYLNIPFKIKAINQQKILKPKELFLGIDVGEYGVGYALVNFKDEEIKIIKSGFIRSKNIASIRDKYRLLQDRSKKGVYFSSTNVVQEVRENAIGEIRNQIHDILIKNNADLIYEYNISNFETGSGRITKIYDSIKKSDVYAENEADKSVIQHVWGIKKSIASHLSAYGSSYTCSNCGRSIFSFSENDIFSSKVIKRDGNIITIQTPKGEVFAYSKDKKFNIGYSFSQEKNKEEMKNLFMKIVKAYARPPLLKSEVLLTQKKLDREFLEKFKKERGNSAIFVCPFVDCQSLADSDIQAAFIMALRGYLKKKKGKDINYLEESLNYLQNFKGKINFSNLLH

SEQ ID NO: 54 - protein, 1338 aa, Artificial Sequence
  Synthetic sequence
MNKKSSNSTGYRLHKDRILFSGGEIMRTIKYPLVVEKNNLNSEEIVEKIRQAIINDDRVIRSDINLNDYIEYTKKGNRLYTLIDFWQDCLRAGVIWQPSTSFLLYLINKLYSKPKAIELIENAKPDISRFFDVDKFSKCFILPGEIREGKILKTFKRELIEALKGEFKKGKKEKIKDEDDYLEKFVEKDARKLIREIADCFFSNDILVTHDLKEGKKEYQDRLWEEKFGIKKGKLLENFKLPDHLRNFKNISFFIIPELSDKSKNFDELIELRRKWLLERKICVREDGDYLENEKKLDEELRNLVGLSDNCNPLSNFLGTVFCELLVPNNLNEDNALEKFYDVFTIVEPKIAELNIKDQIMGSLEFLRLRAKQLGSPNLVNFSKSQNLKANESIKLDGWSLYRQNFGSKMQSWFTSYIERNKLLEDSLKNFKEKIKKAQNFIKNLKNISEEPQQEEEAQQEKEEIVELFEKIFSSLEKVNRENFEVFDSLLSSLRKRLNFFYQQYLYNEAKEGDDVKKHKILGPIFKNIEKPIAFYGETQRKKNEKFVEDTIPILEEGTVFLTTLISNLLDSFSPKQVFPDVRKKDETEEIIYRKELQFFWNKLKDLAVNSKEFEKEYQDIIESAVDESELSKLKELFVNKKKNGSKYNKYTFYKSKYTKGSIEEIKLKGSKEEYLLRFEKLIKSLTNFLTQFNRNKLLQDKDLLLDWVELAKNIVSVLIRFSTNTEFSLNEIKAQSQFKKAKNYLELFKLKKAKKKEFGFIIQSFILSEIKGAATLYSKRKYIASYSVQIVGSNNKFKLFYQPLDSSINISGGPKDFVTKKHKYLIVFQDLKNVKNKDATENRINLLRLNKERKIPLVAYKDDLVSKSLLLSSSPYQLQFLDKYLYRPRGWENIDIKLNEWSFVVEEAYDIEWDLNSKTPKLIPSPKSNRNKLYLAIPFTLKGNVKEPPLDKIVLKSETKKDHSRDKNRLNYPILGVDVGEYGVAWCLTKFDYNQDFSLRDIDIQGKGFIEDRNIGKIKDYFAEIQQKSRKGAYDEDDTTIAKVRENAIGKLRNAIHSILTGSLEGASPVYEDAISNFETGSGKTIKIYNSVKRADTEFKSEADKAEHSLVWGKKDRNQETKYIGRNVSAYASSYTCVNCLHTLFKVKKEDLSNIKILEKDGRIVTMSSPYGPDKKVRGYLSEKEKYEIGYQFKESEEDLKAFRKIVRDFARPPVNKNSEVLEKYAKEILAGNKIEEFRKKRGNSAIFVCPFCQFKADADIQAAFMMAMRGYLRFSGIVPSKENSKNNPQESEDKSLKNSKKQSETGDTFLTKTAEYLQQLRFEIKEKIKEAVKVDF

SEQ ID NO: 55 - protein, 1268 aa, Artificial Sequence
  Synthetic sequence
MTKRKSRLAGYRLHKERILFAGGQIIRTIKYPLTPSYPTEEMTQFLKDFEEAVIADDLKIRGDLNINDYLTYTAKGKPLYTLFDFWVDSLRNGVIWMSKGTMLIDFLATQYNINSPFDNVWKKASPRITSFFKKDEFKEIILCDPVRSSSTKNSFHKRITGYLKDHLKVKNGDSYTIVSNDAQKVVEFIVHSFFNNEGKLILEGEEQFKFWKKEYNLDKAIIESAKPKGKYADITFVIIPELISNLNPKQSLEDLINKRDVWLQGRRFDKEDKLLLSILGLSDNFNGFSNFLGVVLRDLQKENGNKEVLYDAQKTVFPLLGNSKDEVLEALDFLSQKAKLLGVTSLPLVNGWHEYRSIFGGKLKSWFTNSQNRKEELDGQISRFKESLFKARNYLQTENFGEEANKEKEDILSFLSLLENFFTDEKRSIKVEENYQLFEPLLALVKRRLNFFYQRYIQKEGDETKVNELGHFKGLYEKIYKPVAFYGYAAKKVNKKFVNQTFPILEDGIENIEKLISYLQNSFSVQETFEEVKQGKEEIDDPYRKLLQFFWNKYLEDSINSHLFAEKYKDILKGNIEDNEWEKVIDKTKKGKYVFYKSPYAKGSLEEIPIGTSNYLEQLQISILELSKFILSYKKDILLSDVGLLLDWVELSKNVISILLRFNTKKTYRIDDLRLDNFSQAKRYQELFKHGDYPKNEFSFIIQSLVLSEIRGAATLYSKREYIASYSVQVVGSDSKYRIYYIPKEKISITPDVVKSRPESSERKQLMGPHYYAVALGKVLEKKKSEIFNSIALFKKNIKAIFLPESSLRGVFRLSSSPYQLQFLDKFIYRPFGWENIDVSLSEWSFIVEKRYTINWDLRSKKPKLLPVTDTERIKKNKVYIAIPFNLIPSKEVRQAAPLKTIAKGKETREKDLSRLNFPIMGVDVGEYGLAYCLVKIIFDKNTYKILAIELVSDKKEAFGFIEDRNIGNIKDKFAEIQHRARQGSFDEEDTVITRVRENAVGHLRNRLHVIVTLQRSSSVYEDSISNFETGSGRTTKIYNSVKRADTESDTNADKMTHNHVWGEKTKWVGRNVSAYASSYTCVSCLKSLYQVRKEDLSKMRITQRGGRIVTISGPHGDIKGYVSKEEKYNLGYHFRETDDELKNFRKIVQDFARPPVGDHSEVLKKYAKQILEKGKIEEWRKRRGNSSIFICPFCQYITDADVQAAFMMAIRGYLRFSGIVPSRGNKKDQDQEQEDEKTAGESFLEQTQRQLGDVNLSKILEAFSLKI

SEQ ID NO: 56 - protein, 1212 aa, Artificial Sequence
  Synthetic sequence
MVFPAMLFYTRPEYAFLTILISLESSVLFLPKKIIVMTAKTQKNKNSKKTKHFGQTGYALHKSRLVYTGKEAIRSIKFPLKSTSQVKLDDFANKVISDYSLIQGATNINEYLTEYQNAQHSYSLIDFWVDSLRAGVVFAKTPAALTDFLHVVYQRTSPSRLAFDQMYKSLRSKLDYELFLQKIILSTGIRKSAGKHGILSCFKKEWQSDPSVLKEVDYIFSNLIKNGATLSQEEQRNFWKSAYNLQLPAKQKGANLTFYVLPELKFDSNMNISTCFSDRFSFFKKQNDSKLDAIFGFDNNFSAFSNYFGEILQLFKEQKTQKIADYLINFFDIWRGMEDELNRRLVFLSNQAQKLVQANIATNYADFRMSFGGKLQSWFSGYQNQNQKIIEQLNDHGEDLKKINDAVTKQNVKPEDEERKTDLLTDLADLQKYQSELAGGKELEFAKLDLYRDLLAFFRSDFNWFFQNYLLEEKEKKADKDISVNKKYKKLFKNLRLVPEFFGLARKKAYQKYIDSTIPIIKTGWQVVTDALPILRENMSYEFLLNPKKKDYFIANLEKFNRKLKTKTWNRPKFSQLSEKIVRHYNNNQVPTSNQVFYKNRFSNSRQEIILIDGLNQEKELKWLVNSCLECLAKPVLSADAGLMIDQLELTKMVLGWLINGNNDSIINFDKYDLANFIKASKFIEVFKTNQFAGRQLSRFLMSYIFGELRGAVGLFSRQSFVNRYVVSPMASLSNYPLVNDGAKWYLALGKSSKKPKEGMKEFTEYADKESDKAKSAHFFPDDLLYVSSSIYQMQFLHALKRQKEGKKWHKWQQINLKLSDHAFIVEDEYQVKWDLITGKPNLKRVAENRRVFVSVPFILNPLSEQKTQSENIANRYRYLGIDVGEYGLAYAVLDFSNKKRAEIIDQGFIYDGSLRKIRDHFDLIKDTQTKGTFSVPSTALSRVRENAITALRNKIHDLVLRFNAKPVYEFSISNFETGSGKVTKIYNSVKKADIYPEIDTDKAVQKHIWGKNPKLIGQEVSAYATSYTCSKCHQSIYDQGLDKESKIKANQIINASPTGLIKIKLVSKVEAWGFVKGSRKLEITENERTVSLFKGQKIGDEVAQRLVKNFARPPINEASEAIKLAMSQKKLNSNMINFEKLAEDRGNMAMFVCPFCLHVDDADIQAAQNIALRGFLKNEFEKDNNGKKESFNYIQAVKNFFQSGGMADYNE

SEQ ID NO: 57 - protein, 1258 aa, Artificial Sequence
  Synthetic sequence
MNEKKTATQRRNARRRRGERARTKSQELRGYRLHDARIEFSGGLGSMRTVKVELLNPDSSREDPQRGQGLQGKVAKAVFDDYRALYGPMNIEDYLSDPDCPSFLGLWVKAVCLGVIMSRKTATDFGELRGGSKSGQAFDSIPEHLRRQLIKLKWLDWYDKGIRKSSSKASRLKSLTDVFANPKQPDQGVMAAWEQGEKLAESSRDIAALGRREFKDKLFAIPPPTSSVVLDDDVKATKVSRDWQWAVDPQFKLPSTDLDITRALEEVDRQWFERLGNNRGMVQQFFAIGDNGNHLNNGLFGHFFASIRSANLADIVAEMGTAFGFSAEERDIVRQRLETLHEYAQGLPEKPVLASRWAEYRTDMTAKLGSWYSNRTSKGAASITQVWGTINTETGEVKDDGLVRTLENIQSDLPDSCSIKEGILQETLDFIGDRRSSTDRAFTDELELYLATLRSDLNTWCQEQSALWEEKQRQVATPASDEKSKKADNPWAGKGSKTDKWLGALHTRIQSSPLFWGVDKLELWKTLANLKQAIRDEIDKLNEQVEVFGRSAYDEPVGKDADSGEGDRRVDQLSYLSARLGDQAHEEVRQRLDAIALALGVKFSERDDLHRFFVSSRARRRAALLAMPNTITVGKLRELADLTPLWERIKKKPEEPRLLADTVALSKVVNSACASRANPSDQIELTTIHSRLDGYSKNIGHTEFISRATVQSTNGAQNTVALDSLVSPRLFYYNFPNIVESAEPHVSHLEVATRGNLGSFEEFAAKEHRTFDRENPQKDSRNRIDSVNPLAVASSRYQIQFFTWWAGLHRSKETALEVGGSFTIAERQVRLDWSQEKPQAVVSEELRVFVSQPFTIVPDDKKRPATSGTRYIGVDIGEYGLAWSCWEFAPGYWNGSVVNPSKVTCLDYGFLAEPGQRRIVERVKKLRESQATKTFTSPDTYIARLRENVVATYQAQLEALMMAYNAQLVFESEISAFETGGNRVKKIYDAIKRSSVFGRSDAEATDNNQHWGKNGNRSSVKDPDKLRLNEAGQVAARVPWAEPVSAWMTSQTCSACGRVYVRAYRGKNSNEPDSGATGEVRYFDNKQQKILTKTIGADTVWVTDQERKEFERGVYNAMRPNAFMPDGRWTAAGEILEAALKSRGTLDGGRGFAGLHLTSKAQVHEYIEGTGKSHRDAHGNSAIFICPYTDCGHIADADLQASYNIALRGFAYAIVRKKHPELFAGSGSSTDGDEGGGKKPQQKQAFIDEIVRAAGRAS

SEQ ID NO: 58 - protein, 724 aa, Artificial Sequence
  Synthetic sequence
MANRQISPVDSTNNFIFTLYVSFDTVLYARILAFLTLSCLLVGFLEYIYPLGVIYLIMPTNQQYDGLTGYQLHTERLRHTGKSGIRTFKLPLKTNDQELFGNFFENIKHDHEGQIGATNITTWTEEQKSSRQIYSLLDFWLDSVRAGVVFASSSAELNELLSVCGDEDAVDEQVKTAMRAINPTFFKHLKFNDFKEEIALKEGMRSSSTKNSVTRRLYKCLDCTEEDAPEEIQQAVADLIKTFFTTDGKIISRNDQDDYWQVHFGLDKSLYKLDSDIKLTFSFLPDIPFTPEADAHMCLDKYRCWIDENAEKFQLESKEDKTNFLQIHWGIEGNYNAFSNYFNQIIDLLREEEGRQKLLDALLNTSDLWEGAETELQKRFDFLVDKAKQLPKAKCVDSWSDYRTTFGGRLSSWLSNTLNQEEFIKDTVSDQKEELKQIIKNSEKNLYKKAFSAADDNRAVELSHEAVIAQKTLEKLQKSSSFEPQLLGVYRDNLGRLRSLLNKAHQLLPDEIENKSAHEVYSALHERIRLMPKFIGGAKAARFEKYVKSLQILKQGASFLENFEEKVKEAMKSSVSVEVEEISEGYFLRQLNTLKRFYDNANDSRFKGKLSSLFDKDLGVNIEAVSNRETFYISPYSKHDNRAVISVEVANYQQLLKSWVNELKPYWGNIIATENWGEIIDAMQLERIRIGWIYKLYPKLTFAISDDLDELFAKAATYRDLHGH

SEQ ID NO: 59 - protein, 610 aa, Unknown
  Synthetic sequence
LDLITEPIQPHKSSSLRSKEFLEYQISDFLNFSLHSLFFGLASNEGPLVDFKIYDKIVIPKPEERFPKKESEEGKKLDSFDKRVEEYYSDKLEKKIERKLNTEEKNVIDREKTRIWGEVNKLEEIRSIIDEINEIKKQKHISEKSKLLGEKWKKVNNIQETLLSQEYVSLISNLSDELTNKKKELLAKKYSKFDDKIKKIKEDYGLEFDENTIKKEGEKAFLNPDKFSKYQFSSSYLKLIGEIARSLITYKGFLDLNKYPIIFRKPINKVKKIHNLEPDEWKYYIQFGYEQINNPKLETENILGIDRGLTHILAYSVFEPRSSKFILNKLEPNPIEGWKWKLRKLRRSIQNLERRWRAQDNVKLPENQMKKNLRSIEDKVENLYHNLSRKIVDLAKEKNACIVFEKLEGQGMKQHGRKKSDRLRGLNYKLSLFDYGKIAKLIKYKAEIEGIPIYRIDSAYTSQNCAKCVLESRRFAQPEEISCLDDFKEGDNLDKRILEGTGLVEAKIYKKLLKEKKEDFEIEEDIAMFDTKKVIKENKEKTVILDYVYTRRKEIIGTNHKKNIKGIAKYTGNTKIGYCMKHGQVDADLNASRTIALCKNFDINNPEIWK

SEQ ID NO: 60 - protein, 625 aa, Unknown
  Synthetic sequence
MLALKLKIMPTEKQAEILDAMFWKWASICSRIAKMKKKVSVKENKKELSKKIPSNSDIWFSKTQLCQAEVDVGDHKKALKNFEKRQESLLDELKYKVKAINEVINDESKREIDPNNPSKFRIKDSTKKGNLNSPKFFTLKKWQKILQENEKRIKKKESTIEKLKRGNIFFNPTKISLHEEEYSINFGSSKLLLNCFYKYNKKSGINSDQLENKFNEFQNGLNIICSPLQPIRGSSKRSFEFIRNSIINFLMYSLYAKLFGIPRSVKALMKSNKDENKLKLEEKLKKKKSSFNKTVKEFEKMIGRKLSDNESKILNDESKKFFEIIKSNNKYIPSEEYLKLLKDISEEIYNSNIDFKPYKYSILIRKPLSKFKSKKLYNLKPTDYKYYLQLSYEPFSKQLIATKTILGIDRGLKHLLAVSVFDPSQNKFVYNKLIKNPVFKWKKRYHDLKRSIRNRERRIRALTGVHIHENQLIKKLKSMKNKINVLYHNVSKNIVDLAKKYESTIVLERLENLKQHGRSKGKRYKKLNYVLSNFDYKKIESLISYKAKKEGVPVSNINPKYTSKTCAKCLLEVNQLSELKNEYNRDSKNSKIGICNIHGQIDADLNAARVIALCYSKNLNEPHFK

SEQ ID NO: 61 - protein, 517 aa, Unknown
  Synthetic sequence
VINLFGYKFALYPNKTQEELLNKHLGECGWLYNKAIEQNEYYKADSNIEEAQKKFELLPDKNSDEAKVLRGNISKDNYVYRTLVKKKKSEINVQIRKAVVLRPAETIRNLAKVKKKGLSVGRLKFIPIREWDVLPFKQSDQIRLEENYLILEPYGRLKFKMHRPLLGKPKTFCIKRTATDRWTISFSTEYDDSNMRKNDGGQVGIDVGLKTHLRLSNENPDEDPRYPNPKIWKRYDRRLTILQRRISKSKKLGKNRTRLRLRLSRLWEKIRNSRADLIQNETYEILSENKLIAIEDLNVKGMQEKKDKKGRKGRTRAQEKGLHRSISDAAFSEFRRVLEYKAKRFGSEVKPVSAIDSSKECHNCGNKKGMPLESRIYECPKCGLKIDRDLNSAKVILARATGVRPGSNARADTKISATAGASVQTEGTVSEDFRQQMETSDQKPMQGEGSKEPPMNPEHKSSGRGSKHVNIGCKNKVGLYNEDENSRSTEKQIMDENRSTTEDMVEIGALHSPVLTT

SEQ ID NO: 62 - protein, 410 aa, Unknown
  Synthetic sequence
MIASIDYEAVSQALIVFEFKAKGKDSQYQAIDEAIRSYRFIRNSCLRYWMDNKKVGKYDLNKYCKVLAKQYPFANKLNSQARQSAAECSWSAISRFYDNCKRKVSGKKGFPKFKKHARSVEYKTSGWKLSENRKAITFTDKNGIGKLKLKGTYDLHFSQLEDMKRVRLVRRADGYYVQFCISVDVKVETEPTGKAIGLDVGIKYFLADSSGNTIENPQFYRKAEKKLNRANRRKSKKYIRGVKPQSKNYHKARCRYARKHLRVSRQRKEYCKRVAYCVIHSNDVVAYEDLNVKGMVKNRHLAKSISDVAWSTFRHWLEYFAIKYGKLTIPVAPHNTSQNCSNCDKKVPKSLSTRTHICHHCGYSEDRDVNAAKNILKKALSTVGQTGSLKLGEIEPLLVLEQSCTRKFDL

SEQ ID NO: 63 - protein, 486 aa, Unknown
  Synthetic sequence
LAEENTLHLTLAMSLPLNDLPENRTRSELWRRQWLPQKKLSLLLGVNQSVRKAAADCLRWFEPYQELLWWEPTDPDGKKLLDKEGRPIKRTAGHMRVLRKLEEIAPFRGYQLGSAVKNGLRHKVADLLLSYAKRKLDPQFTDKTSYPSIGDQFPIVWTGAFVCYEQSITGQLYLYLPLFPRGSHQEDITNNYDPDRGPALQVFGEKEIARLSRSTSGLLLPLQFDKWGEATFIRGENNPPTWKATHRRSDKKWLSEVLLREKDFQPKRVELLVRNGRIFVNVACEIPTKPLLEVENFMGVSFGLEHLVTVVVINRDGNVVHQRQEPARRYEKTYFARLERLRRRGGPFSQELETFHYRQVAQIVEEALRFKSVPAVEQVGNIPKGRYNPRLNLRLSYWPFGKLADLTSYKAVKEGLPKPYSVYSATAKMLCSTCGAANKEGDQPISLKGPTVYCGNCGTRHNTGFNTALNLARRAQELFVKGVVAR

SEQ ID NO: 64 - protein, 602 aa, Unknown
  Synthetic sequence
MSQSLLKWHDMAGRDKDASRSLQKSAVEGVLLHLTASHRVALEMLEKSVSQTVAVTMEAAQQRLVIVLEDDPTKATSRKRVISADLQFTREEFGSLPNWAQKLASTCPEIATKYADKHINSIRIAWGVAKESTNGDAVEQKLQWQIRLLDVTMFLQQLVLQLADKALLEQIPSSIRGGIGQEVAQQVTSHIQLLDSGTVLKAELPTISDRNSELARKQWEDAIQTVCTYALPFSRERARILDPGKYAAEDPRGDRLINIDPMWARVLKGPTVKSLPLLFVSGSSIRIVKLTLPRKHAAGHKHTFTATYLVLPVSREWINSLPGTVQEKVQWWKKPDVLATQELLVGKGALKKSANTLVIPISAGKKRFFNHILPALQRGFPLQWQRIVGRSYRRPATHRKWFAQLTIGYTNPSSLPEMALGIHFGMKDILWWALADKQGNILKDGSIPGNSILDFSLQEKGKIERQQKAGKNVAGKKYGKSLLNATYRVVNGVLEFSKGISAEHASQPIGLGLETIRFVDKASGSSPVNARHSNWNYGQLSGIFANKAGPAGFSVTEITLKKAQRDLSDAEQARVLAIEATKRFASRIKRLATKRKDDTLFV

SEQ ID NO: 65 - protein, 494 aa, Unknown
  Synthetic sequence
VEPVEKERFYYRTYTFRLDGQPRTQNLTTQSGWGLLTKAVLDNTKHYWEIVHHARIANQPIVFENPVIDEQGNPKLNKLGQPRFWKRPISDIVNQLRALFENQNPYQLGSSLIQGTYWDVAENLASWYALNKEYLAGTATWGEPSFPEPHPLTEINQWMPLTFSSGKVVRLLKNASGRYFIGLPILGENNPCYRMRTIEKLIPCDGKGRVTSGSLILFPLVGIYAQQHRRMTDICESIRTEKGKLAWAQVSIDYVREVDKRRRMRRTRKSQGWIQGPWQEVFILRLVLAHKAPKLYKPRCFAGISLGPKTLASCVILDQDERVVEKQQWSGSELLSLIHQGEERLRSLREQSKPTWNAAYRKQLKSLINTQVFTIVTFLRERGAAVRLESIARVRKSTPAPPVNFLLSHWAYRQITERLKDLAIRNGMPLTHSNGSYGVRFTCSQCGATNQGIKDPTKYKVDIESETFLCSICSHREIAAVNTATNLAKQLLDE

SEQ ID NO: 66 - protein, 526 aa, Unknown
  Synthetic sequence
MNDTETSETLTSHRTVCAHLHVVGETGSLPRLVEAALAELITLNGRATQALLSLAKNGLVLRRDKEENLIAAELTLPCRKNKYADVAAKAGEPILATRINNKGKLVTKKWYGEGNSYHIVRFTPETGMFTVRVFDRYAFDEELLHLHSEVVFGSDLPKGIKAKTDSLPANFLQAVFTSFLELPFQGFPDIVVKPAMKQAAEQLLSYVQLEAGENQQAEYPDTNERDPELRLVEWQKSLHELSVRTEPFEFVRARDIDYYAETDRRGNRFVNITPEWTKFAESPFARRLPLKIPPEFCILLRRKTEGHAKIPNRIYLGLQIFDGVTPDSTLGVLATAEDGKLFWWHDHLDEFSNLEGKPEPKLKNKPQLLMVSLEYDREQRFEESVGGDRKICLVTLKETRNFRRGWNGRILGIHFQHNPVITWALMDHDAEVLEKGFIEGNAFLGKALDKQALNEYLQKGGKWVGDRSFGNKLKGITHTLASLIVRLAREKDAWIALEEISWVQKQSADSVANHEIVEQPHHSLTR

SEQ ID NO: 67 - protein, 649 aa, Unknown
  Synthetic sequence
MNDTETSETLTSHRTVCAHLHVVGETGSLPRLVEAALAELITLNGRATQALLSLAKNGLVLRRDKEENLIAAELTLPCRKNKYADVAAKAGEPILATRINNKGKLVTKKWYGEGNSYHIVRFTPETGMFTVRVFDRYAFDEELLHLHSEVVFGSDLPKGIKAKTDSLPANFLQAVFTSFLELPFQGFPDIVVKPAMKQAAEQLLSYVQLEAGENQQAEYPDTNERDPELRLVEWQKSLHELSVRTEPFEFVRARDIDYYAETDRRGNRFVNITPEWTKFAESPFARRLPLKIPPEFCILLRRKTEGHAKIPNRIYLGLQIFDGVTPDSTLGVLATAEDGKLFWWHDHLDEFSNLEGKPEPKLKNKPQLLMVSLEYDREQRFEESVGGDRKICLVTLKETRNFRRGRHGHTRTDRLPAGNTLWRADFATSAEVAAPKWNGRILGIHFQHNPVITWALMDHDAEVLEKGFIEGNAFLGKALDKQALNEYLQKGGKWVGDRSFGNKLKGITHTLASLIVRLAREKDAWIALEEISWVQKQSADSVANRRFSMWNYSRLATLIEWLGTDIATRDCGTAAPLAHKVSDYLTHFTCPECGACRKAGQKKEIADTVRAGDILTCRKCGFSGPIPDNFIAEFVAKKALERMLKKKPV

SEQ ID NO: 68 - protein, 414 aa, Unknown
  Synthetic sequence
MAKRNFGEKSEALYRAVRFEVRPSKEELSILLAVSEVLRMLFNSALAERQQVFTEFIASLYAELKSASVPEEISEIRKKLREAYKEHSISLFDQINALTARRVEDEAFASVTRNWQEETLDALDGAYKSFLSLRRKGDYDAHSPRSRDSGFFQKIPGRSGFKIGEGRIALSCGAGRKLSFPIPDYQQGRLAETTKLKKFELYRDQPNLAKSGRFWISVVYELPKPEATTCQSEQVAFVALGASSIGVVSQRGEEVIALWRSDKHWVPKIEAVEERMKRRVKGSRGWLRLLNSGKRRMHMISSRQHVQDEREIVDYLVRNHGSHFVVTELVVRSKEGKLADSSKPERGGSLGLNWAAQNTGSLSRLVRQLEEKVKEHGGSVRKHKLTLTEAPPARGAENKLWMARKLRESFLKEV

SEQ ID NO: 69 - protein, 413 aa, Unknown
  Synthetic sequence
LAKNDEKELLYQSVKFEIYPDESKIRVLTRVSNILVLVWNSALGERRARFELYIAPLYEELKKFPRKSAESNALRQKIREGYKEHIPTFFDQLKKLLTPMRKEDPALLGSVPRAYQEETLNTLNGSFVSFMTLRRNNDMDAKPPKGRAEDRFHEISGRSGFKIDGSEFVLSTKEQKLRFPIPNYQLEKLKEAKQIKKFTLYQSRDRRFWISIAYEIELPDQRPFNPEEVIYIAFGASSIGVISPEGEKVIDFWRPDKHWKPKIKEVENRMRSCKKGSRAWKKRAAARRKMYAMTQRQQKLNHREIVASLLRLGFHFVVTEYTVRSKPGKLADGSNPKRGGAPQGFNWSAQNTGSFGEFILWLKQKVKEQGGTVQTFRLVLGQSERPEKRGRDNKIEMVRLLREKYLESQTIVV

SEQ ID NO: 70 - protein, 449 aa, Unknown
  Synthetic sequence
MAKGKKKEGKPLYRAVRFEIFPTSDQITLFLRVSKNLQQVWNEAWQERQSCYEQFFGSIYERIGQAKKRAQEAGFSEVWENEAKKGLNKKLRQQEISMQLVSEKESLLQELSIAFQEHGVTLYDQINGLTARRIIGEFALIPRNWQEETLDSLDGSFKSFLALRKNGDPDAKPPRQRVSENSFYKIPGRSGFKVSNGQIYLSFGKIGQTLTSVIPEFQLKRLETAIKLKKFELCRDERDMAKPGRFWISVAYEIPKPEKVPVVSKQITYLAIGASRLGVVSPKGEFCLNLPRSDYHWKPQINALQERLEGVVKGSRKWKKRMAACTRMFAKLGHQQKQHGQYEVVKKLLRHGVHFVVTELKVRSKPGALADASKSDRKGSPTGPNWSAQNTGNIARLIQKLTDKASEHGGTVIKRNPPLLSLEERQLPDAQRKIFIAKKLREEFLADQK

SEQ ID NO: 71 - protein, 711 aa, Unknown
  Synthetic sequence
MAKREKKDDVVLRGTKMRIYPTDRQVTLMDMWRRRCISLWNLLLNLETAAYGAKNTRSKLGWRSIWARVVEENHAKALIVYQHGKCKKDGSFVLKRDGTVKHPPRERFPGDRKILLGLFDALRHTLDKGAKCKCNVNQPYALTRAWLDETGHGARTADIIAWLKDFKGECDCTAISTAAKYCPAPPTAELLTKIKRAAPADDLPVDQAILLDLFGALRGGLKQKECDHTHARTVAYFEKHELAGRAEDILAWLIAHGGTCDCKIVEEAANHCPGPRLFIWEHELAMIMARLKAEPRTEWIGDLPSHAAQTVVKDLVKALQTMLKERAKAAAGDESARKTGFPKFKKQAYAAGSVYFPNTTMFFDVAAGRVQLPNGCGSMRCEIPRQLVAELLERNLKPGLVIGAQLGLLGGRIWRQGDRWYLSCQWERPQPTLLPKTGRTAGVKIAASIVFTTYDNRGQTKEYPMPPADKKLTAVHLVAGKQNSRALEAQKEKEKKLKARKERLRLGKLEKGHDPNALKPLKRPRVRRSKLFYKSAARLAACEAIERDRRDGFLHRVTNEIVHKFDAVSVQKMSVAPMMRRQKQKEKQIESKKNEAKKEDNGAAKKPRNLKPVRKLLRHVAMARGRQFLEYKYNDLRGPGSVLIADRLEPEVQECSRCGTKNPQMKDGRRLLRCIGVLPDGTDCDAVLPRNRNAARNAEKRLRKHREAHNA

SEQ ID NO: 72 - protein, 574 aa, Unknown
  Synthetic sequence
MNEVLPIPAVGEDAADTIMRGSKMRIYPSVRQAATMDLWRRRCIQLWNLLLELEQAAYSGENRRTQIGWRSIWATVVEDSHAEAVRVAREGKKRKDGTFRKAPSGKEIPPLDPAMLAKIQRQMNGAVDVDPKTGEVTPAQPRLFMWEHELQKIMARLKQAPRTHWIDDLPSHAAQSVVKDLIKALQAMLRERKKRASGIGGRDTGFPKFKKNRYAAGSVYFANTQLRFEAKRGKAGDPDAVRGEFARVKLPNGVGWMECRMPRHINAAHAYAQATLMGGRIWRQGENWYLSCQWKMPKPAPLPRAGRTAAIKIAAAIPITTVDNRGQTREYAMPPIDRERIAAHAAAGRAQSRALEARKRRAKKREAYAKKRHAKKLERGIAAKPPGRARIKLSPGFYAAAAKLAKLEAEDANAREAWLHEITTQIVRNFDVIAVPRMEVAKLMKKPEPPEEKEEQVKAPWQGKRRSLKAARVMMRRTAMALIQTTLKYKAVDLRGPQAYEEIAPLDVTAAACSGCGVLKPEWKMARAKGREIMRCQEPLPGGKTCNTVLTYTRNSARVIGRELAVRLAERQKA

SEQ ID NO: 73 - protein, 400 aa, Unknown
  Synthetic sequence
MTTQKTYNFCFYDQRFFELSKEAGEVYSRSLEEFWKIYDETGVWLSKFDLQKHMRNKLERKLLHSDSFLGAMQQVHANLASWKQAKKVVPDACPPRKPKFLQAILFKKSQIKYKNGFLRLTLGTEKEFLYLKWDINIPLPIYGSVTYSKTRGWKINLCLETEVEQKNLSENKYLSIDLGVKRVATIFDGENTITLSGKKFMGLMHYRNKLNGKTQSRLSHKKKGSNNYKKIQRAKRKTTDRLLNIQKEMLHKYSSFIVNYAIRNDIGNIIIGDNSSTHDSPNMRGKTNQKISQNPEQKLKNYIKYKFESISGRVDIVPEPYTSRKCPHCKNIKKSSPKGRTYKCKKCGFIFDRDGVGAINIYNENVSFGQIISPGRIRSLTEPIGMKFHNEIYFKSYVAA

SEQ ID NO: 74 - protein, 743 aa, Unknown
  Planctomycetes bacterium
MSVRSFQARVECDKQTMEHLWRTHKVFNERLPEIIKILFKMKRGECGQNDKQKSLYKSISQSILEANAQNADYLLNSVSIKGWKPGTAKKYRNASFTWADDAAKLSSQGIHVYDKKQVLGDLPGMMSQMVCRQSVEAISGHIELTKKWEKEHNEWLKEKEKWESEDEHKKYLDLREKFEQFEQSIGGKITKRRGRWHLYLKWLSDNPDFAAWRGNKAVINPLSEKAQIRINKAKPNKKNSVERDEFFKANPEMKALDNLHGYYERNFVRRRKTKKNPDGFDHKPTFTLPHPTIHPRWFVFNKPKTNPEGYRKLILPKKAGDLGSLEMRLLTGEKNKGNYPDDWISVKFKADPRLSLIRPVKGRRVVRKGKEQGQTKETDSYEFFDKHLKKWRPAKLSGVKLIFPDKTPKAAYLYFTCDIPDEPLTETAKKIQWLETGDVTKKGKKRKKKVLPHGLVSCAVDLSMRRGTTGFATLCRYENGKIHILRSRNLWVGYKEGKGCHPYRWTEGPDLGHIAKHKREIRILRSKRGKPVKGEESHIDLQKHIDYMGEDRFKKAARTIVNFALNTENAASKNGFYPRADVLLLENLEGLIPDAEKERGINRALAGWNRRHLVERVIEMAKDAGFKRRVFEIPPYGTSQVCSKCGALGRRYSIIRENNRREIRFGYVEKLFACPNCGYCANADHNASVNLNRRFLIEDSFKSYYDWKRLSEKKQKEEIETIESKLMDKLCAMHKISRGSISK

SEQ ID NO: 75 - protein, 769 aa, Unknown
  Synthetic sequence
MHLWRTHCVFNQRLPALLKRLFAMRRGEVGGNEAQRQVYQRVAQFVLARDAKDSVDLLNAVSLRKRSANSAFKKKATISCNGQAREVTGEEVFAEAVALASKGVFAYDKDDMRAGLPDSLFQPLTRDAVACMRSHEELVATWKKEYREWRDRKSEWEAEPEHALYLNLRPKFEEGEAARGGRFRKRAERDHAYLDWLEANPQLAAWRRKAPPAVVPIDEAGKRRIARAKAWKQASVRAEEFWKRNPELHALHKIHVQYLREFVRPRRTRRNKRREGFKQRPTFTMPDPVRHPRWCLFNAPQTSPQGYRLLRLPQSRRTVGSVELRLLTGPSDGAGFPDAWVNVRFKADPRLAQLRPVKVPRTVTRGKNKGAKVEADGFRYYDDQLLIERDAQVSGVKLLFRDIRMAPFADKPIEDRLLSATPYLVFAVEIKDEARTERAKAIRFDETSELTKSGKKRKTLPAGLVSVAVDLDTRGVGFLTRAVIGVPEIQQTHHGVRLLQSRYVAVGQVEARASGEAEWSPGPDLAHIARHKREIRRLRQLRGKPVKGERSHVRLQAHIDRMGEDRFKKAARKIVNEALRGSNPAAGDPYTRADVLLYESLETLLPDAERERGINRALLRWNRAKLIEHLKRMCDDAGIRHFPVSPFGTSQVCSKCGALGRRYSLARENGRAVIRFGWVERLFACPNPECPGRRPDRPDRPFTCNSDHNASVNLHRVFALGDQAVAAFRALAPRDSPARTLAVKRVEDTLRPQLMRVHKLADAGVDSPF

SEQ ID NO: 76 - protein, 666 aa, Unknown
  Synthetic sequence
MATLVYRYGVRAHGSARQQDAVVSDPAMLEQLRLGHELRNALVGVQHRYEDGKRAVWSGFASVAAADHRVTTGETAVAELEKQARAEHSADRTAATRQGTAESLKAARAAVKQARADRKAAMAAVAEQAKPKIQALGDDRDAEIKDLYRRFCQDGVLLPRCGRCAGDLRSDGDCTDCGAAHEPRKLYWATYNAIREDHQTAVKLVEAKRKAGQPARLRFRRWTGDGTLTVQLQRMHGPACRCVTCAEKLTRRARKTDPQAPAVAADPAYPPTDPPRDPALLASGQGKWRNVLQLGTWIPPGEWSAMSRAERRRVGRSHIGWQLGGGRQLTLPVQLHRQMPADADVAMAQLTRVRVGGRHRMSVALTAKLPDPPQVQGLPPVALHLGWRQRPDGSLRVATWACPQPLDLPPAVADVVVSHGGRWGEVIMPARWLADAEVPPRLLGRRDKAMEPVLEALADWLEAHTEACTARMTPALVRRWRSQGRLAGLTNRWRGQPPTGSAEILTYLEAWRIQDKLLWERESHLRRRLAARRDDAWRRVASWLARHAGVLVVDDADIAELRRRDDPADTDPTMPASAAQAARARAALAAPGRLRHLATITATRDGLGVHTVASAGLTRLHRKCGHQAQPDPRYAASAVVTCPGCGNGYDQDYNAAMLMLDRQQQP

SEQ ID NO: 77 - protein, 564 aa, Unknown
  Synthetic sequence
MSRVELHRAYKFRLYPTPAQVAELAEWERQLRRLYNLAHSQRLAAMQRHVRPKSPGVLKSECLSCGAVAVAEIGTDGKAKKTVKHAVGCSVLECRSCGGSPDAEGRTAHTAACSFVDYYRQGREMTQLLEEDDQLARVVCSARQETLRDLEKAWQRWHKMPGFGKPHFKKRIDSCRIYFSTPKSWAVDLGYLSFTGVASSVGRIKIRQDRVWPGDAKFSSCHVVRDVDEWYAVFPLTFTKEIEKPKGGAVGINRGAVHAIADSTGRVVDSPKFYARSLGVIRHRARLLDRKVPFGRAVKPSPTKYHGLPKADIDAAAARVNASPGRLVYEARARGSIAAAEAHLAALVLPAPRQTSQLPSEGRNRERARRFLALAHQRVRRQREWFLHNESAHYAQSYTKIAIEDWSTKEMTSSEPRDAEEMKRVTRARNRSILDVGWYELGRQIAYKSEATGAEFAKVDPGLRETETHVPEAIVRERDVDVSGMLRGEAGISGTCSRCGGLLRASASGHADAECEVCLHVEVGDVNAAVNVLKRAMFPGAAPPSKEKAKVTIGIKGRKKKRAA

SEQ ID NO: 78 - protein, 565 aa, Unknown
  Synthetic sequence
MSRVELHRAYKFRLYPTPVQVAELSEWERQLRRLYNLGHEQRLLTLTRHLRPKSPGVLKGECLSCDSTQVQEVGADGRPKTTVRHAEQCPTLACRSCGALRDAEGRTAHTVACAFVDYYRQGREMTELLAADDQLARVVCSARQEVLRDLDKAWQRWRKMPGFGKPRFKRRTDSCRIYFSTPKAWKLEGGHLSFTGAATTVGAIKMRQDRNWPASVQFSSCHVVRDVDEWYAVFPLTFVAEVARPKGGAVGINRGAVHAIADSTGRVVDSPRYYARALGVIRHRARLFDRKVPSGHAVKPSPTKYRGLSAIEVDRVARATGFTPGRVVTEALNRGGVAYAECALAAIAVLGHGPERPLTSDGRNREKARKFLALAHQRVRRQREWFLHNESAHYARTYSKIAIEDWSTKEMTASEPQGEETRRVTRSRNRSILDVGWYELGRQLAYKTEATGAEFAQVDPGLKETETNVPKAIADARDVDVSGMLRGEAGISGTCSKCGGLLRAPASGHADAECEICLNVEVGDVNAAVNVLKRAMFPGDAPPASGEKPKVSIGIKGRQKKKKAA

SEQ ID NO: 79 - protein, 499 aa, Unknown
  Synthetic sequence
MEAIATGMSPERRVELGILPGSVELKRAYKFRLYPMKVQQAELSEWERQLRRLYNLAHEQRLAALLRYRDWDFQKGACPSCRVAVPGVHTAACDHVDYFRQAREMTQLLEVDAQLSRVICCARQEVLRDLDKAWQRWRKKLGGRPRFKRRTDSCRIYLSTPKHWEIAGRYLRLSGLASSVGEIRIEQDRAFPEGALLSSCSIVRDVDEWYACLPLTFTQPIERAPHRSVGLNRGVVHALADSDGRVVDSPKFFERALATVQKRSRDLARKVSGSRNAHKARIKLAKAHQRVRRQRAAFLHQESAYYSKGFDLVALEDMSVRKMTATAGEAPEMGRGAQRDLNRGILDVGWYELARQIDYKRLAHGGELLRVDPGQTTPLACVTEEQPARGISSACAVCGIPLARPASGNARMRCTACGSSQVGDVNAAENVLTRALSSAPSGPKSPKASIKIKGRQKRLGTPANRAGEASGGDPPVRGPVEGGTLAYVVEPVSESQSDT

SEQ ID NO: 80 - protein, 560 aa, Unknown
  Synthetic sequence
MTVRTYKYRAYPTPEQAEALTSWLRFASQLYNAALEHRKNAWGRHDAHGRGFRFWDGDAAPRKKSDPPGRWVYRGGGGAHISKNDQGKLLTEFRREHAELLPPGMPALVQHEVLARLERSMAAFFQRATKGQKAGYPRWRSEHRYDSLTFGLTSPSKERFDPETGESLGRGKTVGAGTYHNGDLRLTGLGELRILEHRRIPMGAIPKSVIVRRSGKRWFVSIAMEMPSVEPAASGRPAVGLDMGVVTWGTAFTADTSAAAALVADLRRMATDPSDCRRLEELEREAAQLSEVLAHCRARGLDPARPRRCPKELTKLYRRSLHRLGELDRACARIRRRLQAAHDIAEPVPDEAGSAVLIEGSNAGMRHARRVARTQRRVARRTRAGHAHSNRRKKAVQAYARAKERERSARGDHRHKVSRALVRQFEEISVEALDIKQLTVAPEHNPDPQPDLPAHVQRRRNRGELDAAWGAFFAALDYKAADAGGRVARKPAPHTTQECARCGTLVPKPISLRVHRCPACGYTAPRTVNSARNVLQRPLEEPGRAGPSGANGRGVPHAVA

SEQ ID NO: 81 - protein, 404 aa, Unknown
  Synthetic sequence
MNCRYRYRIYPTPGQRQSLARLFGCVRVVWNDALFLCRQSEKLPKNSELQKLCITQAKKTEARGWLGQVSAIPLQQSVADLGVAFKNFFQSRSGKRKGKKVNPPRVKRRNNRQGARFTRGGFKVKTSKVYLARIGDIKIKWSRPLPSEPSSVTVIKDCAGQYFLSFVVEVKPEIKPPKNPSIGIDLGLKTFASCSNGEKIDSPDYSRLYRKLKRCQRRLAKRQRGSKRRERMRVKVAKLNAQIRDKRKDFLHKLSTKVVNENQVIALEDLNVGGMLKNRKLSRAISQAGWYEFRSLCEGKAEKHNRDFRVISRWEPTSQVCSECGYRWGKIDLSVRSIVCINCGVEHDRDDNASVNIEQAGLKVGVGHTHDSKRTGSACKTSNGAVCVEPSTHREYVQLTLFDW

SEQ ID NO: 82 - protein, 392 aa, Unknown
  Synthetic sequence
MKSRWTFRCYPTPEQEQHLARTFGCVRFVWNWALRARTDAFRAGERIGYPATDKALTLLKQQPETVWLNEVSSVCLQQALRDLQVAFSNFFDKRAAHPSFKRKEARQSANYTERGFSFDHERRILKLAKIGAIKVKWSRKAIPHPSSIRLIRTASGKYFVSLVVETQPAPMPETGESVGVDFGVARLATLSNGERISNPKHGAKWQRRLAFYQKRLARATKGSKRRMRIKRHVARIHEKIGNSRSDTLHKLSTDLVTRFDLICVEDLNLRGMVKNHSLARSLHDASIGSAIRMIEEKAERYGKNVVKIDRWFPSSKTCSDCGHIVEQLPLNVREWTCPECGTTHDRDANAAANILAVGQTVSAHGGTVRRSRAKASERKSQRSANRQGVNRA

SEQ ID NO: 83 - DNA, 136 bp, Artificial Sequence
  Synthetic sequence
gaaggatgcttgcttgaggtgtagttgtcattccttcattcgtctattcgggttctgcaactatacattattgcaccaacactaaggcagagtatggttgcattccttcattcgtctattcgggttctgcaacggg

SEQ ID NO: 84 - DNA, 102 bp, Artificial Sequence
  Synthetic sequence
agaatgcttgcttgaggtgtagttgcattccttcattcgtctattcgggtaattgcaccaacactaaggcagagtatggttgcattccttcattcgtctagg

SEQ ID NO: 85 - DNA, 75 bp, Artificial Sequence
  Synthetic sequence
cgatgcttgcttgaggtgtagttgcattgcaccaacactaaggcagagtatggttgcattccttcattcgtctag

SEQ ID NO: 86 - DNA, 90 bp, Artificial Sequence
  Synthetic sequence
gatgcttgcttgaggtgtagttgcattccttcattctgcaccaacactaaggcagagtatggttgcattccttttcgggttctgcaacgg

SEQ ID NO: 87 - DNA, 73 bp, Artificial Sequence
  Synthetic sequence
gcttgcttgaggtgtagttgcattccttcattccacctacactaaggcagagtatggttgcattccttcattc

SEQ ID NO: 88 - DNA, 73 bp, Artificial Sequence; identical to SEQ ID NO: 87
  Synthetic sequence

SEQ ID NO: 89 - DNA, 63 bp, Artificial Sequence
  Synthetic sequence
gcttgcttgaggtgtagttgcattcgcaacactaaggcagagtatggttgcattccttcattc

SEQ ID NO: 90 - DNA, 66 bp, Artificial Sequence
  Synthetic sequence
cttgcttgaggtgtagttgccgacactaaggcagagtatggttgcattattcgggttctgcaacgg

SEQ ID NO: 91 - DNA, 69 bp, Artificial Sequence
  Synthetic sequence
cttgcttgaggtgtagttgcattccttcattcaaacactaaggcagagtatggttgcattccttcattc

SEQ ID NO: 92 - DNA, 73 bp, Artificial Sequence
  Synthetic sequence
ttgcttgaggtgtagttgcattccttcattctaacactaaggcagagtatggttgcattccttcattcgtcta

SEQ ID NO: 93 - DNA, 58 bp, Artificial Sequence
  Synthetic sequence
ttgcttgaggtgtagttgcatccacactaaggcagagtatggttgcattccttcattc

SEQ ID NO: 94 - DNA, 67 bp, Artificial Sequence
  Synthetic sequence
tgcttaaggtgtagttgcattccttcattccaacactaaggcagagtatggttgcattccttcattc

SEQ ID NO: 95 - DNA, 66 bp, Artificial Sequence
  Synthetic sequence
tgcttgaggtgtagttgcattccttcattccacactaaggcagagtatggttgcattccttcattc

SEQ ID NO: 96 - DNA, 72 bp, Artificial Sequence
  Synthetic sequence
tgcttgaggtgtagttgcattccttcattcaacactaaggcagagtatggttgcattccttcattcgtctat

SEQ ID NO: 97 - DNA, 64 bp, Artificial Sequence
  Synthetic sequence
cttgaggtgtagttgcattccttcattcaacactaaggcagagtatggttgcattccttcattc

SEQ ID NO: 98 - DNA, 59 bp, Artificial Sequence
  Synthetic sequence
cttgaggtgtagttgcattccttaacactaaggcagagtatggttgcattccttcattc

SEQ ID NO: 99 - DNA, 63 bp, Artificial Sequence
  Synthetic sequence
ttgaggtgtagttgcattccttcattcaacactaaggcagagtatggttgcattccttcattc

SEQ ID NO: 100 - DNA, 62 bp, Artificial Sequence
  Synthetic sequence
tgaggtgtagttgcattccttcattcaacactaaggcagagtatggttgcattccttcattc

SEQ ID NO: 101 - DNA, 61 bp, Artificial Sequence
  Synthetic sequence
tgaggtgtagttgcattccttcgttcacactaaggcagagtatggttgcattccttcattc

SEQ ID NO: 102 - DNA, 61 bp, Artificial Sequence
  Synthetic sequence
tgaggtgtagttgcattccttcattcacactaaggcagagtatggttgcattccttcattc

SEQ ID NO: 103 - DNA, 152 bp, Artificial Sequence
  Synthetic sequence
ctcgaggctatttcatactcagaacaaagggattaaggaatgcaacccatttcaaaatctgtggaattatcacaaccattaacatttcatactcagaacaaagggattaaggaatgcaacggacaccttgctatgtccttttgatgtatgtg

SEQ ID NO: 104 - DNA, 60 bp, Artificial Sequence
  Synthetic sequence
ctcgaggctatttcatactcagaacaagctcagaacaaagggaataaggaatgcaacgga

SEQ ID NO: 105 - DNA, 99 bp, Artificial Sequence
  Synthetic sequence
ctcagaacaaagggattaaggaatgcaacccatttcaaaatctgtggaaactcagaacaaagggattaaggaatgcaacggacaccttgctatgtcctc

SEQ ID NO: 106 - DNA, 86 bp, Artificial Sequence
  Synthetic sequence
ctcagaacaaagggattaaggaatgcaacccatttcctcagaacaaagggattaaggaatgcaacggacaccttgctatgtccttc

SEQ ID NO: 107 - DNA, 76 bp, Artificial Sequence
  Synthetic sequence
ctcagaacaaagggattaaggaatgcaacccatttctcagaacaaagggattaaggaatgcaacggacaccttgct

SEQ ID NO: 108 - DNA, 81 bp, Artificial Sequence
  Synthetic sequence
ctcagaacaaagggattaaggaatgcaacccatttcaaaactcagaacaaagggataaggaatgcaacggacaccttgcta

SEQ ID NO: 109 - DNA, 72 bp, Artificial Sequence
  Synthetic sequence
ctcagaacaaagggattaaggaatgcaacccatttcctcagaacaaagggattaaggaatgcaacggacacc

SEQ ID NO: 110 - DNA, 59 bp, Artificial Sequence
  Synthetic sequence
ctcagaacaaagggattaaggaatgcaacccgggattaaggaatgcaacggacaccttg

SEQ ID NO: 111 - DNA, 50 bp, Artificial Sequence
  Synthetic sequence
ctcagaacaaagggattaaggaatgcaaccaacggacaccttgctatgtc

SEQ ID NO: 112 - DNA, 45 bp, Artificial Sequence
  Synthetic sequence
ctcagaacaaagggattaaggaatgcaacccatttcaaaatctgt

SEQ ID NO: 113 - DNA, 41 bp, Artificial Sequence
  Synthetic sequence
ctcagaacaaagggattaaggaatgcaacccatttcaaaat

SEQ ID NO: 114 - DNA, 36 bp, Artificial Sequence
  Synthetic sequence
ctcagaacaaagggattaaggaatgcaacccatttc

SEQ ID NO: 115 - DNA, 36 bp, Artificial Sequence; identical to SEQ ID NO: 114
  Synthetic sequence

SEQ ID NO: 116 - DNA, 36 bp, Artificial Sequence; identical to SEQ ID NO: 114
  Synthetic sequence

SEQ ID NO: 117 - DNA, 37 bp, Artificial Sequence
  Synthetic sequence
ctcagaacaaagggattaaggaatgcaacccatttca

SEQ ID NO: 118 - DNA, 38 bp, Artificial Sequence
  Synthetic sequence
ctcagaacaaagggattaaggaatgcaacccatttcaa

SEQ ID NO: 119 - DNA, 46 bp, Artificial Sequence
  Synthetic sequence
ctcagaacaaagggattaaggaatgcaacccatttcaaaatctgtg

SEQ ID NO: 120 - DNA, 46 bp, Artificial Sequence; identical to SEQ ID NO: 119
  Synthetic sequence

SEQ ID NO: 121 - DNA, 44 bp, Artificial Sequence
  Synthetic sequence
ctcagaacaaagggattaaggaatgcaacccatttcaaaatctg

SEQ ID NO: 122 - protein, 84 aa, Artificial Sequence
  Synthetic sequence
MASMISSSAVTTVSRASRGQSAAMAPFGGLKSMTGFPVRKVNTDITSITSNGGRVKCMQVWPPIGKKKFETLSYLPPLTRDSRA

SEQ ID NO: 123 - protein, 57 aa, Artificial Sequence
  Synthetic sequence
MASMISSSAVTTVSRASRGQSAAMAPFGGLKSMTGFPVRKVNTDITSITSNGGRVKS

SEQ ID NO: 124 - protein, 85 aa, Artificial Sequence
  Synthetic sequence
MASSMLSSATMVASPAQATMVAPFNGLKSSAAFPATRKANNDITSITSNGGRVNCMQVWPPIEKKKFETLSYLPDLTDSGGRVNC

SEQ ID NO: 125 - protein, 76 aa, Artificial Sequence
  Synthetic sequence
MAQVSRICNGVQNPSLISNLSKSSQRKSPLSVSLKTQQHPRAYPISSSWGLKKSGMTLIGSELRPLKVMSSVSTAC

SEQ ID NO: 126 - protein, 76 aa, Artificial Sequence
  Synthetic sequence
MAQVSRICNGVWNPSLISNLSKSSQRKSPLSVSLKTQQHPRAYPISSSWGLKKSGMTLIGSELRPLKVMSSVSTAC

SEQ ID NO: 127 - protein, 72 aa, Artificial Sequence
  Synthetic sequence
MAQINNMAQGIQTLNPNSNFHKPQVPKSSSFLVFGSKKLKNSANSMLVLKKDSIFMQLFCSFRISASVATAC

SEQ ID NO: 128 - protein, 69 aa, Artificial Sequence
  Synthetic sequence
MAALVTSQLATSGTVLSVTDRFRRPGFQGLRPRNPADAALGMRTVGASAAPKQSRKPHRFDRRCLSMVV

SEQ ID NO: 129 - protein, 77 aa, Artificial Sequence
  Synthetic sequence
MAALTTSQLATSATGFGIADRSAPSSLLRHGFQGLKPRSPAGGDATSLSVTTSARATPKQQRSVQRGSRRFPSVVVC

SEQ ID NO: 130 - protein, 57 aa, Artificial Sequence
  Synthetic sequence
MASSVLSSAAVATRSNVAQANMVAPFTGLKSAASFPVSRKQNLDITSIASNGGRVQC

SEQ ID NO: 131 - protein, 65 aa, Artificial Sequence
  Synthetic sequence
MESLAATSVFAPSRVAVPAARALVRAGTVVPTRRTSSTSGTSGVKCSAAVTPQASPVISRSAAAA

SEQ ID NO: 132 - protein, 72 aa, Artificial Sequence
  Synthetic sequence
MGAAATSMQSLKFSNRLVPPSRRLSPVPNNVTCNNLPKSAAPVRTVKCCASSWNSTINGAAATTNGASAASS

SEQ ID NO: 133 - protein, 20 aa, Artificial Sequence
  Synthetic sequence
  misc_feature (4)..(4): Xaa can be any naturally occurring amino acid
  misc_feature (8)..(8): Xaa can be any naturally occurring amino acid
  misc_feature (11)..(11): Xaa can be any naturally occurring amino acid
  misc_feature (15)..(15): Xaa can be any naturally occurring amino acid
  misc_feature (19)..(19): Xaa can be any naturally occurring amino acid
GLFXALLXLLXSLWXLLLXA

SEQ ID NO: 134 - protein, 20 aa, Artificial Sequence
  Synthetic sequence
GLFHALLHLLHSLWHLLLHA

SEQ ID NO: 135 - protein, 7 aa, Artificial Sequence
  Synthetic sequence
PKKKRKV

SEQ ID NO: 136 - protein, 16 aa, Artificial Sequence
  Synthetic sequence
KRPAATKKAGQAKKKK

SEQ ID NO: 137 - protein, 9 aa, Artificial Sequence
  Synthetic sequence
PAAKRVKLD

SEQ ID NO: 138 - protein, 11 aa, Artificial Sequence
  Synthetic sequence
RQRRNELKRSP

SEQ ID NO: 139 - protein, 38 aa, Artificial Sequence
  Synthetic sequence
NQSSNFGPMKGGNFGGRSSGPYGGGGQYFAKPRNQGGY

SEQ ID NO: 140 - protein, 42 aa, Artificial Sequence
  Synthetic sequence
RMRIZFKNKGKDTAELRRRRVEVSVELRKAKKDEQILKRRNV

SEQ ID NO: 141 - protein, 8 aa, Artificial Sequence
  Synthetic sequence
VSRKRPRP

SEQ ID NO: 142 - protein, 8 aa, Artificial Sequence
  Synthetic sequence
PPKKARED

SEQ ID NO: 143 - protein, 8 aa, Artificial Sequence
  Synthetic sequence
PQPKKKPL

SEQ ID NO: 144 - protein, 12 aa, Artificial Sequence
  Synthetic sequence
SALIKKKKKMAP

SEQ ID NO: 145 - protein, 5 aa, Artificial Sequence
  Synthetic sequence
DRLRR

SEQ ID NO: 146 - protein, 7 aa, Artificial Sequence
  Synthetic sequence
PKQKKRK

SEQ ID NO: 147 - protein, 10 aa, Artificial Sequence
  Synthetic sequence
RKLKKKIKKL

SEQ ID NO: 148 - protein, 10 aa, Artificial Sequence
  Synthetic sequence
REKKKFLKRR

SEQ ID NO: 149 - protein, 20 aa, Artificial Sequence
  Synthetic sequence
KRKGDEVDGVDEVAKKKSKK

SEQ ID NO: 150 - protein, 17 aa, Artificial Sequence
  Synthetic sequence
RKCLQAGMNLEARKTKK

SEQ ID NO: 151 - protein, 11 aa, Artificial Sequence
  Synthetic sequence
YGRKKRRQRRR

SEQ ID NO: 152 - protein, 12 aa, Artificial Sequence
  Synthetic sequence
RRQRRTSKLMKR

SEQ ID NO: 153 - protein, 27 aa, Artificial Sequence
  Synthetic sequence
GWTLNSAGYLLGKINLKALAALAKKIL

SEQ ID NO: 154 - protein, 33 aa, Artificial Sequence
  Synthetic sequence
KALAWEAKLAKALAKALAKHLAKALAKALKCEA

SEQ ID NO: 155 - protein, 16 aa, Artificial Sequence
  Synthetic sequence
RQIKIWFQNRRMKWKK

SEQ ID NO: 156 - protein, 4 aa, Artificial Sequence
  Synthetic sequence
AAAA

SEQ ID NO: 157 - protein, 9 aa, Artificial Sequence
  Synthetic sequence
RKKRRQRRR

SEQ ID NO: 158 - protein, 7 aa, Artificial Sequence
  Synthetic sequence
AAAAAAA

SEQ ID NO: 159 - protein, 8 aa, Artificial Sequence
  Synthetic sequence
RKKRRQRR

SEQ ID NO: 160 - protein, 11 aa, Artificial Sequence
  Synthetic sequence
YARAAARQARA

SEQ ID NO: 161 - protein, 11 aa, Artificial Sequence
  Synthetic sequence
THRLPRRRRRR

SEQ ID NO: 162 - protein, 11 aa, Artificial Sequence
  Synthetic sequence
GGRRARRRRRR

SEQ ID NO: 163 - protein, 5 aa, Artificial Sequence
  Synthetic sequence
GSGGS

SEQ ID NO: 164 - protein, 6 aa, Artificial Sequence
  Synthetic sequence
GGSGGS

SEQ ID NO: 165 - protein, 4 aa, Artificial Sequence
  Synthetic sequence
GGGS

SEQ ID NO: 166 - protein, 4 aa, Artificial Sequence
  Synthetic sequence
GGSG

SEQ ID NO: 167 - protein, 5 aa, Artificial Sequence
  Synthetic sequence
GGSGG

SEQ ID NO: 168 - protein, 5 aa, Artificial Sequence
  Synthetic sequence
GSGSG

SEQ ID NO: 169 - protein, 5 aa, Artificial Sequence
  Synthetic sequence
GSGGG

SEQ ID NO: 170 - protein, 5 aa, Artificial Sequence
  Synthetic sequence
GGGSG

SEQ ID NO: 171 - protein, 5 aa, Artificial Sequence
  Synthetic sequence
GSSSG

SEQ ID NO: 172 - RNA, 25 nt, Artificial Sequence
  Synthetic sequence
agcaggauucagguuggguuugagg

SEQ ID NO: 173 - RNA, 19 nt, Artificial Sequence
  Synthetic sequence
auucagguuggguuugagg

SEQ ID NO: 174 - RNA, 26 nt, Artificial Sequence
  Synthetic sequence
cccauaauugauaggaucuaugaggu

SEQ ID NO: 175 - RNA, 26 nt, Artificial Sequence
  Synthetic sequence
agaauuacugauguugugaugaaggc

SEQ ID NO: 176 - RNA, 24 nt, Artificial Sequence
  Synthetic sequence
gcuaguaaugagaggauguugaag

SEQ ID NO: 177 - RNA, 25 nt, Artificial Sequence
  Synthetic sequence
guuagaaaugagaggauauugaagg

SEQ ID NO: 178 - RNA, 25 nt, Artificial Sequence
  Synthetic sequence
cccauuauuggaaggguuuauaagg

SEQ ID NO: 179 - RNA, 25 nt, Artificial Sequence
  Synthetic sequence
agcaggauucagguuggguuugagg

SEQ ID NO: 180 - RNA, 25 nt, Artificial Sequence
  Synthetic sequence
gaauuacugauguugugaugaaggc

SEQ ID NO: 181 - RNA, 25 nt, Artificial Sequence
  Synthetic sequence
cuccgaaaguaucggggauaaaggc

SEQ ID NO: 182 - RNA, 25 nt, Artificial Sequence
  Synthetic sequence
caccgaaauuuggagaggauaaggc

SEQ ID NO: 183 - RNA, 25 nt, Artificial Sequence
  Synthetic sequence
cuccgaauuaucgggaggauaaggc

SEQ ID NO: 184 - RNA, 25 nt, Artificial Sequence
  Synthetic sequence
ccccgaauauaggggacaaaaaggc

SEQ ID NO: 185 - RNA, 36 nt, Artificial Sequence
  Synthetic sequence
gucuagacauacagguggaaaggugagaguaaagac

SEQ ID NO: 186 - RNA, 36 nt, Artificial Sequence; identical to SEQ ID NO: 185
  Synthetic sequence

SEQ ID NO: 187 - RNA, 25 nt, Artificial Sequence
  Synthetic sequence
cuccgugaauacgugggguaaaggc

SEQ ID NO: 188 - RNA, 25 nt, Artificial Sequence
  Synthetic sequence
cuccgaaaguaucggggauaaaggc

SEQ ID NO: 189 - RNA, 25 nt, Artificial Sequence
  Synthetic sequence
aaucgaggguuaguaaccaaaaggc

SEQ ID NO: 190 - RNA, 25 nt, Artificial Sequence
  Synthetic sequence
ccccgaagauuagagggaaaaaggc

SEQ ID NO: 191 - RNA, 25 nt, Artificial Sequence
  Synthetic sequence
cgccgaaaguuaggaacuaaaaggc

SEQ ID NO: 192 - RNA, 23 nt, Artificial Sequence
  Synthetic sequence
ucgaagguuaggaaccaaaaggc

SEQ ID NO: 193 - RNA, 25 nt, Artificial Sequence
  Synthetic sequence
ccccgaaacuacaggggauaaaggc

SEQ ID NO: 194 - RNA, 25 nt, Artificial Sequence
  Synthetic sequence
acccguaaagcagagcgaugaaggc

SEQ ID NO: 195 - RNA, 25 nt, Artificial Sequence
  Synthetic sequence
ccucggauguaacggggauaaaggc

SEQ ID NO: 196 - DNA, 37 bp, Artificial Sequence
  Synthetic sequence
gttgcattccttcattcgtctattcgggttctgcaac

SEQ ID NO: 197 - DNA, 37 bp, Artificial Sequence
  Synthetic sequence
gttgcattccttcattcgtctatccgggttctgcaag

SEQ ID NO: 198 - DNA, 37 bp, Artificial Sequence
  Synthetic sequence
gttgcagaacccgaatagacgaatgaaggaatgcaac

SEQ ID NO: 199 - DNA, 37 bp, Artificial Sequence
  Synthetic sequence
ctatcatattcagaacaaagggattaaggaatgcaac

SEQ ID NO: 200 - DNA, 37 bp, Artificial Sequence
  Synthetic sequence
ctttcatactcagaacaaagggattaaggaatgcaac

SEQ ID NO: 201 - DNA, 37 bp, Artificial Sequence
  Synthetic sequence
gtctacaactcattgatagaaatcaatgagttagaca

SEQ ID NO: 202 - DNA, 37 bp, Artificial Sequence
  Synthetic sequence
gttataaaggcggggatcgcgaccgagcgattgaaag

SEQ ID NO: 203 - DNA, 37 bp, Artificial Sequence
  Synthetic sequence
gttgcattccttaattcattttctcaatatcggaaac

SEQ ID NO: 204 - DNA, 37 bp, Artificial Sequence
  Synthetic sequence
gttgcagaaatagaataaaggaattaaggaatgcaac

SEQ ID NO: 205 - DNA, 37 bp, Artificial Sequence; identical to SEQ ID NO: 200
  Synthetic sequence

SEQ ID NO: 206 - DNA, 37 bp, Artificial Sequence
  Synthetic sequence
atttcatactcagaacaaagggattaaggaatgcaac

SEQ ID NO: 207 - DNA, 38 bp, Artificial Sequence
  Synthetic sequence
gtttcagcgcacgaattaacgagatgagagatgcaact

SEQ ID NO: 208 - DNA, 37 bp, Artificial Sequence
  Synthetic sequence
cttgcagaagctgaatagacgaatcaaggaatgcaac

SEQ ID NO: 209 - DNA, 39 bp, Artificial Sequence
  Synthetic sequence
cacttgcaggccttgaatagaggagttaaggaatgcaac

SEQ ID NO: 210 - DNA, 36 bp, Artificial Sequence
  Synthetic sequence
gtctccatgactgaaaagtcgtggccgaattgaaac

SEQ ID NO: 211 - DNA, 37 bp, Artificial Sequence
  Synthetic sequence
gttgcagcgcccgaactgacgagacgagagatgcaac

SEQ ID NO: 212 - DNA, 37 bp, Artificial Sequence
  Synthetic sequence
gttgcgcgaatagaataaaggaattaaggaatgcaac

SEQ ID NO: 213 - DNA, 38 bp, Artificial Sequence
  Synthetic sequence
agttgcattccttaatccctctgttcagtttgtgcaat

SEQ ID NO: 214 - DNA, 37 bp, Artificial Sequence
  Synthetic sequence
gttgcattcctagtttctctaattagcactgtgcaac

SEQ ID NO: 215 - DNA, 37 bp, Artificial Sequence
  Synthetic sequence
gttgcggcgcgcgaataaacgagactaggaatgcaac

SEQ ID NO: 216 - DNA, 41 bp, Artificial Sequence
  Synthetic sequence
actagttgcattccttaatccctttgttctgaatatgctag

SEQ ID NO: 217 - DNA, 37 bp, Artificial Sequence
  Synthetic sequence
ctttcatattcagaacaaagggattaaggaatgcaac

SEQ ID NO: 218 - DNA, 39 bp, Artificial Sequence
  Synthetic sequence
gttgcagtccttaacccctagtttctgaatatgaaagat

SEQ ID NO: 219 - DNA, 37 bp, Artificial Sequence
  Synthetic sequence
gttgcagcccccgaactaacgagatgagagatgcaac

SEQ ID NO: 220 - DNA, 38 bp, Artificial Sequence
  Synthetic sequence
cttgcagaacaatcatatatgactaatcagactgcaac

SEQ ID NO: 221 - DNA, 37 bp, Artificial Sequence
  Synthetic sequence
gttgcactcaccggtgctcacgacgtagggatgcaac

SEQ ID NO: 222 - DNA, 36 bp, Artificial Sequence
  Synthetic sequence
gtccctactcgctagggaaactaattgaatggaaac

SEQ ID NO: 223 - DNA, 37 bp, Artificial Sequence
  Synthetic sequence
gttgcattcgggtgcaaaacagggagtagagtgtaac

SEQ ID NO: 224 - DNA, 35 bp, Artificial Sequence
  Synthetic sequence
cttccaaactcgagccagtggggagagaagtggca

SEQ ID NO: 225 - DNA, 38 bp, Artificial Sequence
  Synthetic sequence
cctgtagaccggtctcattctgagaggggtatgcaact

SEQ ID NO: 226 - DNA, 37 bp, Artificial Sequence
  Synthetic sequence
gtctcgagaccctacagattttggagaggggtgggac

SEQ ID NO: 227 - DNA, 37 bp, Artificial Sequence
  Synthetic sequence
gtcccacccctctccaaaatctgtagggtctcgagac

SEQ ID NO: 228 - DNA, 37 bp, Artificial Sequence
  Synthetic sequence
gtagcaggactctcctcgagagaaacaggggtatgct

SEQ ID NO: 229 - DNA, 40 bp, Artificial Sequence
  Synthetic sequence
gtacaatacctctcctttaagagagggaggggtacgctac

SEQ ID NO: 230 - DNA, 31 bp, Artificial Sequence
  Synthetic sequence
ccccctcgtttccttcaggggattcctttcc

SEQ ID NO: 231 - DNA, 28 bp, Artificial Sequence
  Synthetic sequence
ggttcccccgggcgcgggtggggtggcg

SEQ ID NO: 232 - DNA, 28 bp, Artificial Sequence
  Synthetic sequence
ggctgctccgggtgcgcgtggagcgagg

SEQ ID NO: 233 - DNA, 35 bp, Artificial Sequence
  Synthetic sequence
gttttataccctttagaatttaaactgtctaaaag

SEQ ID NO: 234 - DNA, 36 bp, Artificial Sequence
  Synthetic sequence
attgcaccggccaacgcaaatctgattgatggacac

SEQ ID NO: 235 - DNA, 36 bp, Artificial Sequence
  Synthetic sequence
gccgcagcggccgacgcggccctgatcgatggacac

SEQ ID NO: 236 - DNA, 36 bp, Artificial Sequence
  Synthetic sequence
gtcgaaatgcccgcgcgggggcgtcgtacccgcgac

SEQ ID NO: 237 - DNA, 29 bp, Artificial Sequence
  Synthetic sequence
ggctagcccgtgcgcgcagggacgagtgg

SEQ ID NO: 238 - DNA, 24 bp, Artificial Sequence
  Synthetic sequence
gcccgtgcgcgcagggacgagtgg

SEQ ID NO: 239 - DNA, 37 bp, Artificial Sequence
  Synthetic sequence
gttgcagcggccgacggagcgcgagcgtggatgccac

SEQ ID NO: 240 - DNA, 29 bp, Artificial Sequence
  Synthetic sequence
ccatcgccccgcgcgcacgtggatgagcc

SEQ ID NO: 241 - DNA, 35 bp, Artificial Sequence
  Synthetic sequence
ctttagacttctccggaagtcgaattaatggaaac

SEQ ID NO: 242 - RNA, 26 nt, Artificial Sequence
  Synthetic sequence
gggcgccccgcgcgagcggggggaag

SEQ ID NO: 243 - RNA, 106 nt, Artificial Sequence
  Synthetic sequence
auaccacccgugcauuucuggaucaaugauccguaccucaauguccgggcgcgcagcuagagcgaccugaaaucugcacgaaaaccggcgaaagccgguuuuuugu

SEQ ID NO: 244 - RNA, 75 nt, Artificial Sequence
  Synthetic sequence
auaccacccgugcauuucuggaucaaugauccguaccucaauguccgggcgcgcagcuagagcgaccugaaaucu

SEQ ID NO: 245 - RNA, 76 nt, Artificial Sequence; identical to SEQ ID NO: 41
  Synthetic sequence

SEQ ID NO: 246 - RNA, 79 nt, Artificial Sequence; identical to SEQ ID NO: 42
  Synthetic sequence

SEQ ID NO: 247 - RNA, 51 nt, Artificial Sequence; identical to SEQ ID NO: 43
  Synthetic sequence

SEQ ID NO: 248 - DNA, 80 bp, Artificial Sequence
  Synthetic sequence
cgattcctccctacagtagttaggtatagccgaaaggtagagactaaatctgtagttggagtgggccgcttgcatcggcc

SEQ ID NO: 249 - DNA, 122 bp, Artificial Sequence
  Synthetic sequence
tcgtctcgagggttaccaaaattggcacttctcgactttaggccgatgcaagcggcccactccactacagatttagtctctaccttgcggctatacctaacttactgtagggaggaatcgtg

SEQ ID NO: 250 - DNA, 91 bp, Artificial Sequence
  Synthetic sequence
cttcactgataaagtggagaaccgcttcaccaaaagctgtcccttaggggattagaacttgagtgaaggtgggctgcttgcatcagcctaa

SEQ ID NO: 251 - DNA, 114 bp, Artificial Sequence
  Synthetic sequence
cagaataatactgacttactaagatatcttgagggtatacccgaaaagattggcgttgttgcaacgcaataagatgtaaatctgaaaaggtttggaatcatataaataatttta

SEQ ID NO: 252 - DNA, 104 bp, Artificial Sequence
  Synthetic sequence
aagccaagatatggaatgccattgtaatattatggtgttgacttagtttagatttaaacaatcttcgatggctatatgcggaaggtttggcgtcgttgtaacgc

SEQ ID NO: 253 - DNA, 263 bp, Artificial Sequence
  Synthetic sequence
cagtgtgcatagctataacactacgcaaagactgctaaagagcgatgtgctctatcgcagtctcacctttaatggacttacggatcttttggagcactaagctccgctgcggtgcaacaccgcccttttcttgcctctgcttgccctttccggttattatagccgggagagtgcggaagattaccgctctagctcgcagcatgttactgagtccgggagagtgcggaagattaccgctctagctcgcagcatgttactgagtc

SEQ ID NO: 254 - DNA, 94 bp, Artificial Sequence
  Synthetic sequence
gcaagtcattcggggacactttttgttatttaaagtgttttagataaatcagtgtcatgctgaataacgacccgacctataaataacataatcc

SEQ ID NO: 255 - DNA, 252 bp, Artificial Sequence
  Synthetic sequence
gtccttaaggtactacacattacatgtgaacgtggagctaataatagaaatattattagactacaccttattaataacggtaggagatctatatggtcttgaatggaatagtaattgtgaaattataatttctgttcttagctacttaagatggctcgttgcaagccactcgggggctctcttgaagtcaaagagctttagacaaatcagtgtcaaactgaataacgacccgaccatgacttcataatcccg

SEQ ID NO: 256 - protein, 632 aa, Unknown
  Synthetic sequence
MSDESLVSSEDKLAIKIKIVPNAEQAKMLDEMFKKWSSICNRISRGKEDIETLRPDEGKELQFNSTQLNSATMDVSDLKKAMARQGERLEAEVSKLRGRYETIDASLRDPSRRHTNPQKPSSFYPSDWDISGRLTPRFHTARHYSTELRKLKAKEDKMLKTINKIKNGKIVFKPKRITLWPSSVNMAFKGSRLLLKPFANGFEMELPIVISPQKTADGKSQKASAEYMRNALLGLAGYSINQLLFGMNRSQKMLANAKKPEKVEKFLEQMKNKDANFDKKIKALEGKWLLDRKLKESEKSSIAVVRTKFFKSGKVELNEDYLKLLKHMANEILERDGFVNLNKYPILSRKPMKRYKQKNIDNLKPNMWKYYIQFGYEPIFERKASGKPKNIMGIDRGLTHLLAVAVFSPDQQKFLFNHLESNPIMHWKWKLRKIRRSIQHMERRIRAEKNKHIHEAQLKKRLGSIEEKTEQHYHIVSSKIINWAIEYEAAIVLESLSHMKQRGGKKSVRTRALNYALSLFDYEKVARLITYKARIRGIPVYDVLPGMTSKTCATCLLNGSQGAYVRGLETTKAAGKATKRKNMKIGKCMVCNSSENSMIDADLNAARVIAICKYKNLNDPQPAGSRKVFKRF

SEQ ID NO: 257 - DNA, 18 bp, Artificial Sequence
  Synthetic sequence
atcaataccaaactctgg

SEQ ID NO: 258 - DNA, 23 bp, Artificial Sequence
  Synthetic sequence
aaggcatcaataccaaactctgg

SEQ ID NO: 259 - DNA, 29 bp, Artificial Sequence
  Synthetic sequence
gcgatgaaggcatcaataccaaactctgg

SEQ ID NO: 260 - DNA, 33 bp, Artificial Sequence
  Synthetic sequence
cagagcgatgaaggcatcaataccaaactctgg

SEQ ID NO: 261 - DNA, 43 bp, Artificial Sequence
  Synthetic sequence
acccgtaaagcagagcgatgaaggcatcaataccaaactctgg

SEQ ID NO: 262 - DNA, 32 bp, Artificial Sequence
  Synthetic sequence
gcgatgaaggcatcaataccaaactctggcgg

SEQ ID NO: 263 - DNA, 31 bp, Artificial Sequence
  Synthetic sequence
gcgatgaaggcatcaataccaaactctggcg

SEQ ID NO: 264 - DNA, 30 bp, Artificial Sequence
  Synthetic sequence
gcgatgaaggcatcaataccaaactctggc

SEQ ID NO: 265 - DNA, 29 bp, Artificial Sequence
  Synthetic sequence
gcgatgaaggcatcaataccaaactctgg

SEQ ID NO: 266 - DNA, 28 bp, Artificial Sequence
  Synthetic sequence
gcgatgaaggcatcaataccaaactctg

SEQ ID NO: 267 - DNA, 27 bp, Artificial Sequence
  Synthetic sequence
gcgatgaaggcatcaataccaaactct

SEQ ID NO: 268 - DNA, 43 bp, Artificial Sequence
  Synthetic sequence
atcaataccaaactctggacccgtaaagcagagcgatgaaggc

SEQ ID NO: 269 - DNA, 43 bp, Artificial Sequence
  Synthetic sequence
acccgtaaagcagagcgatgggcgtatcaataccaaactctgg

SEQ ID NO: 270 - DNA, 29 bp, Artificial Sequence
  Synthetic sequence
gcgatgggcgtatcaataccaaactctgg

SEQ ID NO: 271 - DNA, 68 bp, Artificial Sequence
  Synthetic sequence
acccgtaaagcagagcgatgaaggcatcaataccaaactctggacccgtaaagcagagcgatgaaggc

SEQ ID NO: 272 - DNA, 68 bp, Artificial Sequence
  Synthetic sequence
gccttcatcgctctgctttacgggtccagagtttggtattgatgccttcatcgctctgctttacgggt

SEQ ID NO: 273 - DNA, 50 bp, Artificial Sequence
  Synthetic sequence
cttagttaaggatgttccaggttctttcgggagccttggccttctccctt

SEQ ID NO: 274 - DNA, 70 bp, Artificial Sequence
  Synthetic sequence
ccgacttcgctgataaaaatcttagttaaggatgttccaggttctttcgggagccttggccttctccctt

SEQ ID NO: 275 - DNA, 70 bp, Artificial Sequence
  Synthetic sequence
cttagttaaggatgttccaggttctttcgggagccttggccttctcccttaacctatgccactaatgatt

SEQ ID NO: 276 - DNA, 101 bp, Artificial Sequence
  Synthetic sequence
cttagttaaggatgttccaggttctttcgggagccttggccttctcccttaacctatgccactaatgattaggaacacgatgaatgaaaagaagacggcga

SEQ ID NO: 277 - DNA, 50 bp, Artificial Sequence
  Synthetic sequence
cttagttaaggatgttccaggttctttcgggaacgccggccttctccctt

SEQ ID NO: 278 - DNA, 50 bp, Artificial Sequence
  Synthetic sequence
cttagttaaggatgttccaggttctttcgggagccttgacgccctccctt

SEQ ID NO: 279 - DNA, 50 bp, Artificial Sequence
  Synthetic sequence
cttagttaaggatgttccaggttctttcgggaacgccgacgccctccctt

SEQ ID NO: 280 - DNA, 204 bp, Artificial Sequence
  Synthetic sequence
ggagagcaactacccgtaaagcagagcgatgaaggcatcaataccaaactctggacccgtaaagcagagcgatgaaggcttgtcgtgtgagcagcttacccgtaaagcagagcgatgaaggcacattggccgacttcgctgataaaaatcttagttaaggatgttccaggttctttcgggagccttggccttctcccttaacct

SEQ ID NO: 281 - DNA, 103 bp, Artificial Sequence
  Synthetic sequence
cttagttaaggatgttccaggttctttcgggagccttggccttctcccttaacctatgccactaatgattgaaagcgatgaaggcatcaataccaaactctgg

SEQ ID NO: 282 - DNA, 111 bp, Artificial Sequence
  Synthetic sequence
cttagttaaggatgttccaggttctttcgggagccttggccttctcccttaacctatgccactaatgattgaaaaaaaaaaagcgatgaaggcatcaataccaaactctgg

SEQ ID NO: 283 - DNA, 123 bp, Artificial Sequence
  Synthetic sequence
ggagagcaactacccgtaaagcagagcgatgaaggcatcaataccaaactctggacccgtaaagcagagcgatgaaggcttgtcgtgtgagcagcttacccgtaaagcagagcgatgaaggca

SEQ ID NO: 284 - DNA, 53 bp, Artificial Sequence
  Synthetic sequence
gcctgcccgcagactaatcaataccaaactctggcggcgtaaactttccagtc

SEQ ID NO: 285 - DNA, 53 bp, Artificial Sequence
  Synthetic sequence
gcctgcccgcagactatactgttattgttgtactcggcgtaaactttccagtc

SEQ ID NO: 286 - DNA, 53 bp, Artificial Sequence
  Synthetic sequence
gcctgcccgcagactgatcaataccaaactctggcggcgtaaactttccagtc

SEQ ID NO: 287 - DNA, 53 bp, Artificial Sequence
  Synthetic sequence
gcctgcccgcagactcatcaataccaaactctggcggcgtaaactttccagtc

SEQ ID NO: 288 - DNA, 53 bp, Artificial Sequence
  Synthetic sequence
gcctgcccgcagacttatcaataccaaactctggcggcgtaaactttccagtc

SEQ ID NO: 289 - DNA, 53 bp, Artificial Sequence
  Synthetic sequence
gcctgcccgcagacaaatcaataccaaactctggcggcgtaaactttccagtc

SEQ ID NO: 290 - DNA, 53 bp, Artificial Sequence
  Synthetic sequence
gcctgcccgcagacgaatcaataccaaactctggcggcgtaaactttccagtc

SEQ ID NO: 291 - DNA, 53 bp, Artificial Sequence
  Synthetic sequence
gcctgcccgcagaccaatcaataccaaactctggcggcgtaaactttccagtc

SEQ ID NO: 292 - DNA, 53 bp, Artificial Sequence
  Synthetic sequence
gcctgcccgcagacccatcaataccaaactctggcggcgtaaactttccagtc

SEQ ID NO: 293 - DNA, 53 bp, Artificial Sequence
  Synthetic sequence
gcctgcccgcagattgatcaataccaaactctggcggcgtaaactttccagtc

SEQ ID NO: 294 - DNA, 53 bp, Artificial Sequence
  Synthetic sequence
gcctgcccgcagagtaatcaataccaaactctggcggcgtaaactttccagtc

SEQ ID NO: 295 - DNA, 53 bp, Artificial Sequence
  Synthetic sequence
gcctgcccgcagaataatcaataccaaactctggcggcgtaaactttccagtc

SEQ ID NO: 296 - DNA, 53 bp, Artificial Sequence
  Synthetic sequence
gcctgcccgcagactagccaataccaaactctggcggcgtaaactttccagtc

SEQ ID NO: 297 - DNA, 53 bp, Artificial Sequence
  Synthetic sequence
gcctgcccgcagactaattgataccaaactctggcggcgtaaactttccagtc

SEQ ID NO: 298 - DNA, 53 bp, Artificial Sequence
  Synthetic sequence
gcctgcccgcagactaatcagcaccaaactctggcggcgtaaactttccagtc

SEQ ID NO: 299 - DNA, 53 bp, Artificial Sequence
  Synthetic sequence
gcctgcccgcagactaatcaatgtcaaactctggcggcgtaaactttccagtc

SEQ ID NO: 300 - DNA, 53 bp, Artificial Sequence
  Synthetic sequence
gcctgcccgcagactaatcaatactgaactctggcggcgtaaactttccagtc

SEQ ID NO: 301 - DNA, 53 bp, Artificial Sequence
  Synthetic sequence
gcctgcccgcagactaatcaataccaggctctggcggcgtaaactttccagtc

SEQ ID NO: 302 - DNA, 53 bp, Artificial Sequence
  Synthetic sequence
gcctgcccgcagactaatcaataccaaatcctggcggcgtaaactttccagtc

SEQ ID NO: 303 - DNA, 53 bp, Artificial Sequence
  Synthetic sequence
gcctgcccgcagactaatcaataccaaacttcggcggcgtaaactttccagtc

SEQ ID NO: 304 - DNA, 53 bp, Artificial Sequence
  Synthetic sequence
gcctgcccgcagactaatcaataccaaactctaacggcgtaaactttccagtc

SEQ ID NO: 305 - DNA, 53 bp, Artificial Sequence
  Synthetic sequence
gcctgcccgcagactaatcaataccaaactctggtagcgtaaactttccagtc

SEQ ID NO: 306 - DNA, 53 bp, Artificial Sequence
  Synthetic sequence
gactggaaagtttacgccgccagagtttggtattgattagtctgcgggcaggc

SEQ ID NO: 307 - DNA, 53 bp, Artificial Sequence
  Synthetic sequence
gactggaaagtttacgccgagtacaacaataacagtatagtctgcgggcaggc

SEQ ID NO: 308 - DNA, 53 bp, Artificial Sequence
  Synthetic sequence
gactggaaagtttacgccgccagagtttggtattgatcagtctgcgggcaggc

SEQ ID NO: 309 - DNA, 53 bp, Artificial Sequence
  Synthetic sequence
gactggaaagtttacgccgccagagtttggtattgatgagtctgcgggcaggc

SEQ ID NO: 310 - DNA, 53 bp, Artificial Sequence
  Synthetic sequence
gactggaaagtttacgccgccagagtttggtattgataagtctgcgggcaggc

SEQ ID NO: 311 - DNA, 53 bp, Artificial Sequence
  Synthetic sequence
gactggaaagtttacgccgccagagtttggtattgatttgtctgcgggcaggc

SEQ ID NO: 312 - DNA, 53 bp, Artificial Sequence
  Synthetic sequence
gactggaaagtttacgccgccagagtttggtattgattcgtctgcgggcaggc

SEQ ID NO: 313 - DNA, 53 bp, Artificial Sequence
  Synthetic sequence
gactggaaagtttacgccgccagagtttggtattgattggtctgcgggcaggc

SEQ ID NO: 314 - DNA, 53 bp, Artificial Sequence
  Synthetic sequence
gactggaaagtttacgccgccagagtttggtattgatgggtctgcgggcaggc

SEQ ID NO: 315 - DNA, 53 bp, Artificial Sequence
  Synthetic sequence
gactggaaagtttacgccgccagagtttggtattgatcaatctgcgggcaggc

SEQ ID NO: 316 - DNA, 53 bp, Artificial Sequence
  Synthetic sequence
gactggaaagtttacgccgccagagtttggtattgattactctgcgggcaggc

SEQ ID NO: 317 - DNA, 53 bp, Artificial Sequence
  Synthetic sequence
gactggaaagtttacgccgccagagtttggtattgattattctgcgggcaggc

SEQ ID NO: 318 - DNA, 53 bp, Artificial Sequence
  Synthetic sequence
gactggaaagtttacgccgccagagtttggtattggctagtctgcgggcaggc

SEQ ID NO: 319 - DNA, 53 bp, Artificial Sequence
  Synthetic sequence
gactggaaagtttacgccgccagagtttggtatcaattagtctgcgggcaggc

SEQ ID NO: 320 - DNA, 53 bp, Artificial Sequence
  Synthetic sequence
gactggaaagtttacgccgccagagtttggtgctgattagtctgcgggcaggc

SEQ ID NO: 321 - DNA, 53 bp, Artificial Sequence
  Synthetic sequence
gactggaaagtttacgccgccagagtttgacattgattagtctgcgggcaggc

SEQ ID NO: 322 - DNA, 53 bp, Artificial Sequence
  Synthetic sequence
gactggaaagtttacgccgccagagttcagtattgattagtctgcgggcaggc

SEQ ID NO: 323 - DNA, 53 bp, Artificial Sequence
  Synthetic sequence
gactggaaagtttacgccgccagagcctggtattgattagtctgcgggcaggc

SEQ ID NO: 324 - DNA, 53 bp, Artificial Sequence
  Synthetic sequence
gactggaaagtttacgccgccaggatttggtattgattagtctgcgggcaggc

SEQ ID NO: 325 - DNA, 53 bp, Artificial Sequence
  Synthetic sequence
gactggaaagtttacgccgccgaagtttggtattgattagtctgcgggcaggc

SEQ ID NO: 326 - DNA, 53 bp, Artificial Sequence
  Synthetic sequence
gactggaaagtttacgccgttagagtttggtattgattagtctgcgggcaggc

SEQ ID NO: 327 - DNA, 53 bp, Artificial Sequence
  Synthetic sequence
gactggaaagtttacgctaccagagtttggtattgattagtctgcgggcaggc

SEQ ID NO: 328 - protein, 529 aa, Artificial Sequence
  Synthetic sequence
PEEKTSKLKPNSINLAANYDANEKFNCKECKFHPFKNKKRYEFNFYNNLHGCKSCTKSTNNPAVKRIEIGYQKLKFEIKNQMEAYPWFGRLRINFYSDEKRKMSELNEMQVTGVKNKIFFDAIECAWREILKKRFRESKETLITIPKLKNKAGHGARKHRNKKLLIRRRAFMKKNFHFLDNDSISYRSFANNIACVLPSKVGVDIGGIISPDVGKDIKPVDISLNLMWASKEGIKSGRKVEIYSTQYDGNMVKKIEAETGEDKSWGKNRKRRQTSLLLSIPKPSKQVQEFDFKEWPRYKDIEKKVQWRGFPIKIIFDSNHNSIEFGTYQGGKQKVLPIPFNDSKTTPLGSKMNKLEKLRFNSKIKSRLGSAIAANKFLEAARTYCVDSLYHEVSSANAIGKGKIFIEYYLEILSQNYIEAAQKQLQRFIESIEQWFVADPFQGRLKQYFKDDLKRAKCFLCANREVQTTCYAAVKLHKSCAEKVKDKNKELAIKERNNKEDAVIKEVEASNYPRVIRLKLTKTITNKAM

SEQ ID NO: 329 - protein, 507 aa, Artificial Sequence
  Synthetic sequence
ELIVNENKDPLNIGKTAKAVFKEIDPTSINRAANYDASIELACKECKFKPFNNTKRHDFSFYSNWHRCSPNSCLQSTYRAKIRKTEIGYEKLKNEILNQMQYYPWFGRLYQNFFNDQRDKMTSLDEIQVTGVQNKIFFNTVEKAWREIIKKRFRDNKETMRTIPDLKNKSGHGSRKLSNKSLLRRRFAFAQKSFKLVDNSDVSYRAFSNNVACVLPSKIGVDIGGIINKDLKREYIPQEITFNVFWKQHDGLKKGRNIEIHSVQYKGEIVKRIEADTGEDKAWGKNRQRRFTSLILKITPKQGGKKIWKFPEKKNASDYEYFPIPIEFILDNGDASIKFGGEEGEVGKQKHLLIPFNDSKATPLSSKQMLLETSRFNAEVKSTIGLALYANYFVSYARNYVIKSTYHKNSKKGQIVTEIYLESISQNFVRAIQRQLQSLMLNLKDWGFMQTHKKELKKYFGSDLEGSKGGQKRREKEEKIEKEIEASYLPRLIRLSLTKSVTKAEEM

SEQ ID NO: 330 - protein, 500 aa, Artificial Sequence
  Synthetic sequence
KEPLNIGKTAKAVFKEIDPTSLNRAANYDASIELNCKECKFKPFKNVKRYEFNFYNNWYRCNPNSCLQSTYKAQVRKVEIGYEKLKNEILTQMQYYPWFGRLYQNFFHDERDKMTSLDEIQVIGVQNKVFFNTVEKAWREIIKKRFKDNKETMETIPELKHAAGHGKRKLSNKSLLRRRFAFVQKSFKFVDNSDVSYRSFSNNIACVLPSRIGVDLGGVISRNPKREYIPQEISFNAFWKQHEGLKKGRNIEIQSVQYKGETVKRIEADTGEDKAWGKNRQRRFTSLILKLVPKQGGKKVWKYPEKRNEGNYEYFPIPIEFILDSGETSIRFGGDEGEAGKQKHLVIPFNDSKATPLASQQTLLENSRFNAEVKSCIGLAIYANYFYGYARNYVISSIYHKNSKNGQAITAIYLESIAHNYVKAIERQLQNLLLNLRDFSFMESHKKELKKYFGGDLEGTGGAQKRREKEEKIEKEIEQSYLPRLIRLSLTKMVTKQVEM

SEQ ID NO: 331 - protein, 726 aa, Artificial Sequence
  Synthetic sequence
SESENKIIEQYYAFLYSFRDKYEKPEFKNRGDIKRKLQNKWEDFLKEQNLKNDKKLSNYIFSNRNFRRSYDREEENEEGIDEKKSKPKRINCFEKEKNLKDQYDKDAINASANKDGAQKWGCFECIFFPMYKIESGDPNKRIIINKTRFKLFDFYLNLKGCKSCLRSTYHPYRSNVYIESNYDKLKREIGNFLQQKNIFQRMRKAKVSEGKYLTNLDEYRLSCVAMHFKNRWLFFDSIQKVLRETIKQRLKQMRESYDEQAKTKRSKGHGRAKYEDQVRMIRRRAYSAQAHKLLDNGYITLFDYDDKEINKVCLTAINQEGFDIGGYLNSDIDNVMPPIEISFHLKWKYNEPILNIESPFSKAKISDYLRKIREDLNLERGKEGKARSKKNVRRKVLASKGEDGYKKIFTDFFSKWKEELEGNAMERVLSQSSGDIQWSKKKRIHYTTLVLNINLLDKKGVGNLKYYEIAEKTKILSFDKNENKFWPITIQVLLDGYEIGTEYDEIKQLNEKTSKQFTIYDPNTKIIKIPFTDSKAVPLGMLGINIATLKTVKKTERDIKVSKIFKGGLNSKIVSKIGKGIYAGYFPTVDKEILEEVEEDTLDNEFSSKSQRNIFLKSIIKNYDKMLKEQLFDFYSFLVRNDLGVRFLTDRELQNIEDESFNLEKRFFETDRDRIARWFDNTNTDDGKEKFKKLANEIVDSYKPRLIRLPVVRVIKRIQPVKQREM

SEQ ID NO: 332 - protein, 517 aa, Artificial Sequence
  Synthetic sequence
KYSTRDFSELNEIQVTACKQDEFFKVIQNAWREIIKKRFLENRENFIEKKIFKNKKGRGKRQESDKTIQRNRASVMKNFQLIENEKIILRAPSGHVACVFPVKVGLDIGGFKTDDLEKNIFPPRTITINVFWKNRDRQRKGRKLEVWGIKARTKLIEKVHKWDKLEEVKKKRLKSLEQKQEKSLDNWSEVNNDSFYKVQIDELQEKIDKSLKGRTMNKILDNKAKESKEAEGLYIEWEKDFEGEMLRRIEASTGGEEKWGKRRQRRHTSLLLDIKNNSRGSKEIINFYSYAKQGKKEKKIEFFPFPLTITLDAEEESPLNIKSIPIEDKNATSKYFSIPFTETRATPLSILGDRVQKFKTKNISGAIKRNLGSSISSCKIVQNAETSAKSILSLPNVKEDNNMEIFINTMSKNYFRAMMKQMESFIFEMEPKTLIDPYKEKAIKWFEVAASSRAKRKLKKLSKADIKKSELLLSNTEEFEKEKQEKLEALEKEIEEFYLPRIVRLQLTKTILETPVM

SEQ ID NO: 333 - protein, 481 aa, Artificial Sequence
  Synthetic sequence
KKLQLLGHKILLKEYDPNAVNAAANFETSTAELCGQCKMKPFKNKRRFQYTFGKNYHGCLSCIQNVYYAKKRIVQIAKEELKHQLTDSIASIPYKYTSLFSNTNSIDELYILKQERAAFFSNTNSIDELYITGIENNIAFKVISAIWDEIIKKRRQRYAESLTDTGTVKANRGHGGTAYKSNTRQEKIRALQKQTLHMVTNPYISLARYKNNYIVATLPRTIGMHIGAIKDRDPQKKLSDYAINFNVFWSDDRQLIELSTVQYTGDMVRKIEAETGENNKWGENMKRTKTSLLLEILTKKTTDELTFKDWAFSTKKEIDSVTKKTYQGFPIGIIFEGNESSVKFGSQNYFPLPFDAKITPPTAEGFRLDWLRKGSFSSQMKTSYGLAIYSNKVTNAIPAYVIKNMFYKIARAENGKQIKAKFLKKYLDIAGNNYVPFIIMQHYRVLDTFEEMPISQPKVIRLSLTKTQHIIIKKDKTDSKM

SEQ ID NO: 334 - protein, 534 aa, Artificial Sequence
  Synthetic sequence
NTSNLINLGKKAINISANYDANLEVGCKNCKFLSSNGNFPRQTNVKEGCHSCEKSTYEPSIYLVKIGERKAKYDVLDSLKKFTFQSLKYQSKKSMKSRNKKPKELKEFVIFANKNKAFDVIQKSYNHLILQIKKEINRMNSKKRKKNHKRRLFRDREKQLNKLRLIESSNLFLPRENKGNNHVFTYVAIHSVGRDIGVIGSYDEKLNFETELTYQLYFNDDKRLLYAYKPKQNKIIKIKEKLWNLRKEKEPLDLEYEKPLNKSITFSIKNDNLFKVSKDLMLRRAKFNIQGKEKLSKEERKINRDLIKIKGLVNSMSYGRFDELKKEKNIWSPHIYREVRQKEIKPCLIKNGDRIEIFEQLKKKMERLRRFREKRQKKISKDLIFAERIAYNFHTKSIKNTSNKINIDQEAKRGKASYMRKRIGYETFKNKYCEQCLSKGNVYRNVQKGCSCFENPFDWIKKGDENLLPKKNEDLRVKGAFRDEALEKQIVKIAFNIAKGYEDFYDNLGESTEKDLKLKFKVGTTINEQESLKL

SEQ ID NO: 335 - protein, 537 aa, Artificial Sequence
  Synthetic sequence
TSNPIKLGKKAINISANYDSNLQIGCKNCKFLSYNGNFPRQTNVKEGCHSCEKSTYEPPVYTVRIGERRSKYDVLDSLKKFIFLSLKYRQSKKMKTRSKGIRGLEEFVISANLKKAMDVIQKSYRHLILNIKNEIVRMNGKKRNKNHKRLLFRDREKQLNKLRLIEGSSFFKPPTVKGDNSIFTCVAIHNIGRDIGIAGDYFDKLEPKIELTYQLYYEYNPKKESEINKRLLYAYKPKQNKIIEIKEKLWNLRKEKSPLDLEYEKPLTKSITFLVKRDGVFRISKDLMLRKAKFIIQGKEKLSKEERKINRDLIKIKSNIISLTYGRFDELKKDKTIWSPHIFRDVKQGKITPCIERKGDRMDIFQQLRKKSERLRENRKKRQKKISKDLIFAERIAYNFHTKSIKNTSNLINIKHEAKRGKASYMRKRIGNETFRIKYCEQCFPKNNVYKNVQKGCSCFEDPFEYIKKGNEDLIPNKNQDLKAKGAFRDDALEKQIIKVAFNIAKGYEDFYENLKKTTEKDIRLKFKVGTIISEEM

SEQ ID NO: 336 - protein, 541 aa, Artificial Sequence
  Synthetic sequence
NNSINLSKKAINISANYDANLQVRCKNCKFLSSNGNFPRQTDVKEGCHSCEKSTYEPPVYDVKIGEIKAKYEVLDSLKKFTFQSLKYQLSKSMKFRSKKIKELKEFVIFAKESKALNVINRSYKHLILNIKNDINRMNSKKRIKNHKGRLFLDRQKQLSKLKLIEGSSFFVPAKNVGNKSVFTCVAIHSIGRDIGIAGLYDSFTKPVNEITYQIFFSGERRLLYAYKPKQLKILSIKENLWSLKNEKKPLDLLYEKPLGKNLNFNVKGGDLFRVSKDLMIRNAKFNVHGRQRLSDEERLINRNFIKIKGEVVSLSYGRFEELKKDRKLWSPHIFKDVRQNKIKPCLVMQGQRIDIFEQLKRKLELLKKIRKSRQKKLSKDLIFGERIAYNFHTKSIKNTSNKINIDSDAKRGRASYMRKRIGNETFKLKYCDVCFPKANVYRRVQNGCSCSENPYNYIKKGDKDLLPKKDEGLAIKGAFRDEKLNKQIIKVAFNIAKGYEDFYDDLKKRTEKDVDLKFKIGTTVLDQKPMEIFDGIVITWL

SEQ ID NO: 337 - protein, 542 aa, Artificial Sequence
  Synthetic sequence
LLTTVVETNNLAKKAINVAANFDANIDRQYYRCTPNLCRFIAQSPRETKEKDAGCSSCTQSTYDPKVYVIKIGKLLAKYEILKSLKRFLFMNRYFKQKKTERAQQKQKIGTELNEMSIFAKATNAMEVIKRATKHCTYDIIPETKSLQMLKRRRHRVKVRSLLKILKERRMKIKKIPNTFIEIPKQAKKNKSDYYVAAALKSCGIDVGLCGAYEKNAEVEAEYTYQLYYEYKGNSSTKRILYCYNNPQKNIREFWEAFYIQGSKSHVNTPGTIRLKMEKFLSPITIESEALDFRVWNSDLKIRNGQYGFIKKRSLGKEAREIKKGMGDIKRKIGNLTYGKSPSELKSIHVYRTERENPKKPRAARKKEDNFMEIFEMQRKKDYEVNKKRRKEATDAAKIMDFAEEPIRHYHTNNLKAVRRIDMNEQVERKKTSVFLKRIMQNGYRGNYCRKCIKAPEGSNRDENVLEKNEGCLDCIGSEFIWKKSSKEKKGLWHTNRLLRRIRLQCFTTAKAYENFYNDLFEKKESSLDIIKLKVSITTKSM

SEQ ID NO: 338 - protein, 564 aa, Artificial Sequence
  Synthetic sequence
ASTMNLAKQAINFAANYDSNLEIGCKGCKFMSTWSKKSNPKFYPRQNNQANKCHSCTYSTGEPEVPIIEIGERAAKYKIFTALKKFVFMSVAYKERRRQRFKSKKPKELKELAICSNREKAMEVIQKSVVHCYGDVKQEIPRIRKIKVLKNHKGRLFYKQKRSKIKIAKLEKGSFFKTFIPKVHNNGCHSCHEASLNKPILVTTALNTIGADIGLINDYSTIAPTETDISWQVYYEFIPNGDSEAVKKRLLYFYKPKGALIKSIRDKYFKKGHENAVNTGFFKYQGKIVKGPIKFVNNELDFARKPDLKSMKIKRAGFAIPSAKRLSKEDREINRESIKIKNKIYSLSYGRKKTLSDKDIIKHLYRPVRQKGVKPLEYRKAPDGFLEFFYSLKRKERRLRKQKEKRQKDMSEIIDAADEFAWHRHTGSIKKTTNHINFKSEVKRGKVPIMKKRIANDSFNTRHCGKCVKQGNAINKYYIEKQKNCFDCNSIEFKWEKAALEKKGAFKLNKRLQYIVKACFNVAKAYESFYEDFRKGEEESLDLKFKIGTTTTLKQYPQNKARAM

SEQ ID NO: 339 - protein, 610 aa, Artificial Sequence
  Synthetic sequence
HSHNLMLTKLGKQAINFAANYDANLEIGCKNCKFLSYSPKQANPKKYPRQTDVHEDGNIACHSCMQSTKEPPVYIVPIGERKSKYEILTSLNKFTFLALKYKEKKRQAFRAKKPKELQELAIAFNKEKAIKVIDKSIQHLILNIKPEIARIQRQKRLKNRKGKLLYLHKRYAIKMGLIKNGKYFKVGSPKKDGKKLLVLCALNTIGRDIGIIGNIEENNRSETEITYQLYFDCLDANPNELRIKEIEYNRLKSYERKIKRLVYAYKPKQTKILEIRSKFFSKGHENKVNTGSFNFENPLNKSISIKVKNSAFDFKIGAPFIMLRNGKFHIPTKKRLSKEEREINRTLSKIKGRVFRLTYGRNISEQGSKSLHIYRKERQHPKLSLEIRKQPDSFIDEFEKLRLKQNFISKLKKQRQKKLADLLQFADRIAYNYHTSSLEKTSNFINYKPEVKRGRTSYIKKRIGNEGFEKLYCETCIKSNDKENAYAVEKEELCFVCKAKPFTWKKTNKDKLGIFKYPSRIKDFIRAAFTVAKSYNDFYENLKKKDLKNEIFLKFKIGLILSHEKKNHISIAKSVAEDERISGKSIKNILNKSIKLEKNCYSCFFHKEDM

SEQ ID NO: 340 - protein, 552 aa, Artificial Sequence
  Synthetic sequence
SLERVIDKRNLAKKAINIAANFDANINKGFYRCETNQCMFIAQKPRKTNNTGCSSCLQSTYDPVIYVVKVGEMLAKYEILKSLKRFVFMNRSFKQKKTEKAKQKERIGGELNEMSIFANAALAMGVIKRAIRHCHVDIRPEINRLSELKKTKHRVAAKSLVKIVKQRKTKWKGIPNSFIQIPQKARNKDADFYVASALKSGGIDIGLCGTYDKKPHADPRWTYQLYFDTEDESEKRLLYCYNDPQAKIRDFWKTFYERGNPSMVNSPGTIEFRMEGFFEKMTPISIESKDFDFRVWNKDLLIRRGLYEIKKRKNLNRKAREIKKAMGSVKRVLANMTYGKSPTDKKSIPVYRVEREKPKKPRAVRKEENELADKLENYRREDFLIRNRRKREATEIAKIIDAAEPPIRHYHTNHLRAVKRIDLSKPVARKNTSVFLKRIMQNGYRGNYCKKCIKGNIDPNKDECRLEDIKKCICCEGTQNIWAKKEKLYTGRINVLNKRIKQMKLECFNVAKAYENFYDNLAALKEGDLKVLKLKVSIPALNPEASDPEEDM

SEQ ID NO: 341 - protein, 534 aa, Artificial Sequence
  Synthetic sequence
NASINLGKRAINLSANYDSNLVIGCKNCKFLSFNGNFPRQTNVREGCHSCDKSTYAPEVYIVKIGERKAKYDVLDSLKKFTFQSLKYQIKKSMRERSKKPKELLEFVIFANKDKAFNVIQKSYEHLILNIKQEINRMNGKKRIKNHKKRLFKDREKQLNKLRLIGSSSLFFPRENKGDKDLFTYVAIHSVGRDIGVAGSYESHIEPISDLTYQLFINNEKRLLYAYKPKQNKIIELKENLWNLKKEKKPLDLEFTKPLEKSITFSVKNDKLFKVSKDLMLRQAKFNIQGKEKLSKEERQINRDFSKIKSNVISLSYGRFEELKKEKNIWSPHIYREVKQKEIKPCIVRKGDRIELFEQLKRKMDKLKKFRKERQKKISKDLNFAERIAYNFHTKSIKNTSNKINIDQEAKRGKASYMRKRIGNESFRKKYCEQCFSVGNVYHNVQNGCSCFDNPIELIKKGDEGLIPKGKEDRKYKGALRDDNLQMQIIRVAFNIAKGYEDFYNNLKEKTEKDLKLKFKIGTTISTQESNNKEM

SEQ ID NO: 342 - protein, 577 aa, Artificial Sequence
  Synthetic sequence
SNLIKLGKQAINFAANYDANLEVGCKNCKFLSSTNKYPRQTNVHLDNKMACRSCNQSTMEPAIYIVRIGEKKAKYDIYNSLTKFNFQSLKYKAKRSQRFKPKQPKELQELSIAVRKEKALDIIQKSIDHLIQDIRPEIPRIKQQKRYKNHVGKLFYLQKRRKNKLNLIGKGSFFKVFSPKEKKNELLVICALTNIGRDIGLIGNYNTIINPLFEVTYQLYYDYIPKKNNKNVQRRLLYAYKSKNEKILKLKEAFFKRGHENAVNLGSFSYEKPLEKSLTLKIKNDKDDFQVSPSLRIRTGRFFVPSKRNLSRQEREINRRLVKIKSKIKNMTYGKFETARDKQSVHIFRLERQKEKLPLQFRKDEKEFMEEFQKLKRRTNSLKKLRKSRQKKLADLLQLSEKVVYNNHTGTLKKTSNFLNFSSSVKRGKTAYIKELLGQEGFETLYCSNCINKGQKTRYNIETKEKCFSCKDVPFVWKKKSTDKDRKGAFLFPAKLKDVIKATFTVAKAYEDFYDNLKSIDEKKPYIKFKIGLILAHVRHEHKARAKEEAGQKNIYNKPIKIDKNCKECFFFKEEAM

SEQ ID NO: 343 - protein, 613 aa, Artificial Sequence
  Synthetic sequence
NTTRKKFRKRTGFPQSDNIKLAYCSAIVRAANLDADIQKKHNQCNPNLCVGIKSNEQSRKYEHSDRQALLCYACNQSTGAPKVDYIQIGEIGAKYKILQMVNAYDFLSLAYNLTKLRNGKSRGHQRMSQLDEVVIVADYEKATEVIKRSINHLLDDIRGQLSKLKKRTQNEHITEHKQSKIRRKLRKLSRLLKRRRWKWGTIPNPYLKNWVFTKKDPELVTVALLHKLGRDIGLVNRSKRRSKQKLLPKVGFQLYYKWESPSLNNIKKSKAKKLPKRLLIPYKNVKLFDNKQKLENAIKSLLESYQKTIKVEFDQFFQNRTEEIIAEEQQTLERGLLKQLEKKKNEFASQKKALKEEKKKIKEPRKAKLLMEESRSLGFLMANVSYALFNTTIEDLYKKSNVVSGCIPQEPVVVFPADIQNKGSLAKILFAPKDGFRIKFSGQHLTIRTAKFKIRGKEIKILTKTKREILKNIEKLRRVWYREQHYKLKLFGKEVSAKPRFLDKRKTSIERRDPNKLADQTDDRQAELRNKEYELRHKQHKMAERLDNIDTNAQNLQTLSFWVGEADKPPKLDEKDARGFGVRTCISAWKWFMEDLLKKQEEDPLLKLKLSIM

SEQ ID NO: 344 - protein, 615 aa, Artificial Sequence
  Synthetic sequence
PKKPKFQKRTGFPQPDNLRKEYCLAIVRAANLDADFEKKCTKCEGIKTNKKGNIVKGRTYNSADKDNLLCYACNISTGAPAVDYVFVGALEAKYKILQMVKAYDFHSLAYNLAKLWKGRGRGHQRMGGLNEVVIVSNNEKALDVIEKSLNHFHDEIRGELSRLKAKFQNEHLHVHKESKLRRKLRKISRLLKRRRWKWDVIPNSYLRNFTFTKTRPDFISVALLHRVGRDIGLVTKTKIPKPTDLLPQFGFQIYYTWDEPKLNKLKKSRLRSEPKRLLVPYKKIELYKNKSVLEEAIRHLAEVYTEDLTICFKDFFETQKRKFVSKEKESLKRELLKELTKLKKDFSERKTALKRDRKEIKEPKKAKLLMEESRSLGFLAANTSYALFNLIAADLYTKSKKACSTKLPRQLSTILPLEIKEHKSTTSLAIKPEEGFKIRFSNTHLSIRTPKFKMKGADIKALTKRKREILKNATKLEKSWYGLKHYKLKLYGKEVAAKPRFLDKRNPSIDRRDPKELMEQIENRRNEVKDLEYEIRKGQHQMAKRLDNVDTNAQNLQTKSFWVGEADKPPELDSMEAKKLGLRTCISAWKWFMKDLVLLQEKSPNLKLKLSLTEM

SEQ ID NO: 345 - protein, 775 aa, Artificial Sequence
  Synthetic sequence
KFSKRQEGFLIPDNIDLYKCLAIVRSANLDADVQGHKSCYGVKKNGTYRVKQNGKKGVKEKGRKYVFDLIAFKGNIEKIPHEAIEEKDQGRVIVLGKFNYKLILNIEKNHNDRASLEIKNKIKKLVQISSLETGEFLSDLLSGKIGIDEVYGIIEPDVFSGKELVCKACQQSTYAPLVEYMPVGELDAKYKILSAIKGYDFLSLAYNLSRNRANKKRGHQKLGGGELSEVVISANYDKALNVIKRSINHYHVEIKPEISKLKKKMQNEPLKVMKQARIRRELHQLSRKVKRLKWKWGMIPNPELQNIIFEKKEKDFVSYALLHTLGRDIGLFKDTSMLQVPNISDYGFQIYYSWEDPKLNSIKKIKDLPKRLLIPYKRLDFYIDTILVAKVIKNLIELYRKSYVYETFGEEYGYAKKAEDILFDWDSINLSEGIEQKIQKIKDEFSDLLYEARESKRQNFVESFENILGLYDKNFASDRNSYQEKIQSMIIKKQQENIEQKLKREFKEVIERGFEGMDQNKKYYKVLSPNIKGGLLYTDTNNLGFFRSHLAFMLLSKISDDLYRKNNLVSKGGNKGILDQTPETMLTLEFGKSNLPNISIKRKFFNIKYNSSWIGIRKPKFSIKGAVIREITKKVRDEQRLIKSLEGVWHKSTHFKRWGKPRFNLPRHPDREKNNDDNLMESITSRREQIQLLLREKQKQQEKMAGRLDKIDKEIQNLQTANFQIKQIDKKPALTEKSEGKQSVRNALSAWKWFMEDLIKYQKRTPILQLKLAKM

SEQ ID NO: 346 - protein, 777 aa, Artificial Sequence
  Synthetic sequence
KFSKRQEGFVIPENIGLYKCLAIVRSANLDADVQGHVSCYGVKKNGTYVLKQNGKKSIREKGRKYASDLVAFKGDIEKIPFEVIEEKKKEQSIVLGKFNYKLVLDVMKGEKDRASLTMKNKSKKLVQVSSLGTDEFLLTLLNEKFGIEEIYGIIEPEVFSGKKLVCKACQQSTYAPLVEYMPVGELDSKYKILSAIKGYDFLSLAYNLARHRSNKKRGHQKLGGGELSEVVISANNAKALNVIKRSLNHYYSEIKPEISKLRKKMQNEPLKVGKQARMRRELHQLSRKVKRLKWKWGKIPNLELQNITFKESDRDFISYALLHTLGRDIGMFNKTEIKMPSNILGYGFQIYYDWEEPKLNTIKKSKNTPKRILIPYKKLDFYNDSILVARAIKELVGLFQESYEWEIFGNEYNYAKEAEVELIKLDEESINGNVEKKLQRIKENFSNLLEKAREKKRQNFIESFESIARLYDESFTADRNEYQREIQSFIIEKQKQSIEKKLKNEFKKIVEKKFNEQEQGKKHYRVLNPTIINEFLPKDKNNLGFLRSKIAFILLSKISDDLYKKSNAVSKGGEKGIIKQQPETILDLEFSKSKLPSINIKKKLFNIKYTSSWLGIRKPKFNIKGAKIREITRRVRDVQRTLKSAESSWYASTHFRRWGFPRFNQPRHPDKEKKSDDRLIESITLLREQIQILLREKQKGQKEMAGRLDDVDKKIQNLQTANFQIKQTGDKPALTEKSAGKQSFRNALSAWKWFMENLLKYQNKTPDLKLKIARTVM

SEQ ID NO: 347 - protein, 610 aa, Artificial Sequence
  Synthetic sequence
KWIEPNNIDFNKCLAITRSANLDADVQGHKMCYGIKTNGTYKAIGKINKKHNTGIIEKRRTYVYDLIVTKEKNEKIVKKTDFMAIDEEIEFDEKKEKLLKKYIKAEVLGTGELIRKDLNDGEKFDDLCSIEEPQAFRRSELVCKACNQSTYASDIRYIPIGEIEAKYKILKAIKGYDFLSLKYNLGRLRDSKKRGHQKMGQGELKEFVICANKEKALDVIKRSLNHYLNEVKDEISRLNKKMQNEPLKVNDQARWRRELNQISRRLKRLKWKWGEIPNPELKNLIFKSSRPEFVSYALIHTLGRDIGLINETELKPNNIQEYGFQIYYKWEDPELNHIKKVKNIPKRFIIPYKNLDLFGKYTILSRAIEGILKLYSSSFQYKSFKDPNLFAKEGEKKITNEDFELGYDEKIKKIKDDFKSYKKALLEKKKNTLEDSLNSILSVYEQSLLTEQINNVKKWKEGLLKSKESIHKQKKIENIEDIISRIEELKNVEGWIRTKERDIVNKEETNLKREIKKELKDSYYEEVRKDFSDLKKGEESEKKPFREEPKPIVIKDYIKFDVLPGENSALGFFLSHLSFNLFDSIQYELFEKSRLSSSKHPQIPETILDL

SEQ ID NO: 348 - protein, 632 aa, Artificial Sequence
  Synthetic sequence
FRKFVKRSGAPQPDNLNKYKCIAIVRAANLDADIMSNESSNCVMCKGIKMNKRKTAKGAAKTTELGRVYAGQSGNLLCTACTKSTMGPLVDYVPIGRIRAKYTILRAVKEYDFLSLAYNLARTRVSKKGGRQKMHSLSELVIAAEYEIAWNIIKSSVIHYHQETKEEISGLRKKLQAEHIHKNKEARIRREMHQISRRIKRLKWKWHMIPNSELHNFLFKQQDPSFVAVALLHTLGRDIGMINKPKGSAKREFIPEYGFQIYYKWMNPKLNDINKQKYRKMPKRSLIPYKNLNVFGDRELIENAMHKLLKLYDENLEVKGSKFFKTRVVAISSKESEKLKRDLLWKGELAKIKKDFNADKNKMQELFKEVKEPKKANALMKQSRNMGFLLQNISYGALGLLANRMYEASAKQSKGDATKQPSIVIPLEMEFGNAFPKLLLRSGKFAMNVSSPWLTIRKPKFVIKGNKIKNITKLMKDEKAKLKRLETSYHRATHFRPTLRGSIDWDSPYFSSPKQPNTHRRSPDRLSADITEYRGRLKSVEAELREGQRAMAKKLDSVDMTASNLQTSNFQLEKGEDPRLTEIDEKGRSIRNCISSWKKFMEDLMKAQEANPVIKIKIALKDESSVLSEDSM

SEQ ID NO: 349 - protein, 625 aa, Artificial Sequence
  Synthetic sequence
KFHPENLNKSYCLAIVRAANLDADIQGHINCIGIKSNKSDRNYENKLESLQNVELLCKACTKSTYKPNINSVPVGEKKAKYSILSEIKKYDFNSLVYNLKKYRKGKSRGHQKLNELRELVITSEYKKALDVINKSVNHYLVNIKNKMSKLKKILQNEHIHVGTLARIRRERNRISRKLDHYRKKWKFVPNKILKNYVFKNQSPDFVSVALLHKLGRDIGLITKTAILQKSFPEYSLQLYYKYDTPKLNYLKKSKFKSLPKRILISYKYPKFDINSNYIEESIDKLLKLYEESPIYKNNSKIIEFFKKSEDNLIKSENDSLKRGIMKEFEKVTKNFSSKKKKLKEELKLKNEDKNSKMLAKVSRPIGFLKAYLSYMLFNIISNRIFEFSRKSSGRIPQLPSCIINLGNQFENFKNELQDSNIGSKKNYKYFCNLLLKSSGFNISYEEEHLSIKTPNFFINGRKLKEITSEKKKIRKENEQLIKQWKKLTFFKPSNLNGKKTSDKIRFKSPNNPDIERKSEDNIVENIAKVKYKLEDLLSEQRKEFNKLAKKHDGVDVEAQCLQTKSFWIDSNSPIKKSLEKKNEKVSVKKKMKAIRSCISAWKWFMADLIEAQKETPMIKLKLALM

SEQ ID NO: 350 - protein, 517 aa, Artificial Sequence
  Synthetic sequence
TTLVPSHLAGIEVMDETTSRNEDMIQKETSRSNEDENYLGVKNKCGINVHKSGRGSSKHEPNMPPEKSGEGQMPKQDSTEMQQRFDESVTGETQVSAGATASIKTDARANSGPRVGTARALIVKASNLDRDIKLGCKPCEYIRSELPMGKKNGCNHCEKSSDIASVPKVESGFRKAKYELVRRFESFAADSISRHLGKEQARTRGKRGKKDKKEQMGKVNLDEIAILKNESLIEYTENQILDARSNRIKEWLRSLRLRLRTRNKGLKKSKSIRRQLITLRRDYRKWIKPNPYRPDEDPNENSLRLHTKLGVDIGVQGGDNKRMNSDDYETSFSITWRDTATRKICFTKPKGLLPRHMKFKLRGYPELILYNEELRIQDSQKFPLVDWERIPIFKLRGVSLGKKKVKALNRITEAPRLVVAKRIQVNIESKKKKVLTRYVYNDKSINGRLVKAEDSNKDPLLEFKKQAEEINSDAKYYENQEIAKNYLWGCEGLHKNLLEEQTKNPYLAFKYGFLNIV

SEQ ID NO: 351 - protein, 410 aa, Artificial Sequence
  Synthetic sequence
LDFKRTCSQELVLLPEIEGLKLSGTQGVTSLAKKLINKAANVDRDESYGCHHCIHTRTSLSKPVKKDCNSCNQSTNHPAVPITLKGYKIAFYELWHRFTSWAVDSISKALHRNKVMGKVNLDEYAVVDNSHIVCYAVRKCYEKRQRSVRLHKRAYRCRAKHYNKSQPKVGRIYKKSKRRNARNLKKEAKRYFQPNEITNGSSDALFYKIGVDLGIAKGTPETEVKVDVSICFQVYYGDARRVLRVRKMDELQSFHLDYTGKLKLKGIGNKDTFTIAKRNESLKWGSTKYEVSRAHKKFKPFGKKGSVKRKCNDYFRSIASWSCEAASQRAQSNLKNAFPYQKALVKCYKNLDYKGVKKNDMWYRLCSNRIFRYSRIAEDIAQYQSDKGKAKFEFVILAQSVAEYDISAIM

SEQ ID NO: 352 - protein, 602 aa, Artificial Sequence
  Synthetic sequence
VFLTDDKRKTALRKIRSAFRKTAEIALVRAQEADSLDRQAKKLTIETVSFGAPGAKNAFIGSLQGYNWNSHRANVPSSGSAKDVFRITELGLGIPQSAHEASIGKSFELVGNVVRYTANLLSKGYKKGAVNKGAKQQREIKGKEQLSFDLISNGPISGDKLINGQKDALAWWLIDKMGFHIGLAMEPLSSPNTYGITLQAFWKRHTAPRRYSRGVIRQWQLPFGRQLAPLIHNFFRKKGASIPIVLTNASKKLAGKGVLLEQTALVDPKKWWQVKEQVTGPLSNIWERSVPLVLYTATFTHKHGAAHKRPLTLKVIRISSGSVFLLPLSKVTPGKLVRAWMPDINILRDGRPDEAAYKGPDLIRARERSFPLAYTCVTQIADEWQKRALESNRDSITPLEAKLVTGSDLLQIHSTVQQAVEQGIGGRISSPIQELLAKDALQLVLQQLFMTVDLLRIQWQLKQEVADGNTSEKAVGWAIRISNIHKDAYKTAIEPCTSALKQAWNPLSGFEERTFQLDASIVRKRSTAKTPDDELVIVLRQQAAEMTVAVTQSVSKELMELAVRHSATLHLLVGEVASKQLSRSADKDRGAMDHWKLLSQSM

SEQ ID NO: 353 - protein, 494 aa, Artificial Sequence
  Synthetic sequence
EDLLQKALNTATNVAAIERHSCISCLFTESEIDVKYKTPDKIGQNTAGCQSCTFRVGYSGNSHTLPMGNRIALDKLRETIQRYAWHSLLFNVPPAPTSKRVRAISELRVAAGRERLFTVITFVQTNILSKLQKRYAANWTPKSQERLSRLREEGQHILSLLESGSWQQKEVVREDQDLIVCSALTKPGLSIGAFCRPKYLKPAKHALVLRLIFVEQWPGQIWGQSKRTRRMRRRKDVERVYDISVQAWALKGKETRISECIDTMRRHQQAYIGVLPFLILSGSTVRGKGDCPILKEITRMRYCPNNEGLIPLGIFYRGSANKLLRVVKGSSFTLPMWQNIETLPHPEPFSPEGWTATGALYEKNLAYWSALNEAVDWYTGQILSSGLQYPNQNEFLARLQNVIDSIPRKWFRPQGLKNLKPNGQEDIVPNEFVIPQNAIRAHHVIEWYHKTNDLVAKTLLGWGSQTTLNQTRPQGDLRFTYTRYYFREKEVPEV

SEQ ID NO: 354 - protein, 649 aa, Artificial Sequence
  Synthetic sequence
VPKKKLMRELAKKAVFEAIFNDPIPGSFGCKRCTLIDGARVTDAIEKKQGAKRCAGCEPCTFHTLYDSVKHALPAATGCDRTAIDTGLWEILTALRSYNWMSFRRNAVSDASQKQVWSIEELAIWADKERALRVILSALTHTIGKLKNGFSRDGVWKGGKQLYENLAQKDLAKGLFANGEIFGKELVEADHDMLAWTIVPNHQFHIGLIRGNWKPAAVEASTAFDARWLTNGAPLRDTRTHGHRGRRFNRTEKLTVLCIKRDGGVSEEFRQERDYELSVMLLQPKNKLKPEPKGELNSFEDLHDHWWFLKGDEATALVGLTSDPTVGDFIQLGLYIRNPIKAHGETKRRLLICFEPPIKLPLRRAFPSEAFKTWEPTINVFRNGRRDTEAYYDIDRARVFEFPETRVSLEHLSKQWEVLRLEPDRENTDPYEAQQNEGAELQVYSLLQEAAQKMAPKVVIDPFGQFPLELFSTFVAQLFNAPLSDTKAKIGKPLDSGFVVESHLHLLEEDFAYRDFVRVTFMGTEPTFRVIHYSNGEGYWKKTVLKGKNNIRTALIPEGAKAAVDAYKNKRCPLTLEAAILNEEKDRRLVLGNKALSLLAQTARGNLTILEALAAEVLRPLSGTEGVVHLHACVTRHSTLTESTETDNM

SEQ ID NO: 355 - protein, 414 aa, Artificial Sequence
  Synthetic sequence
VEKLFSERLKRAMWLKNEAGRAPPAETLTLKHKRVSGGHEKVKEELQRVLRSLSGTNQAAWNLGLSGGREPKSSDALKGEKSRVVLETVVFHSGHNRVLYDVIEREDQVHQRSSIMHMRRKGSNLLRLWGRSGKVRRKMREEVAEIKPVWHKDSRWLAIVEEGRQSVVGISSAGLAVFAVQESQCTTAEPKPLEYVVSIWFRGSKALNPQDRYLEFKKLKTTEALRGQQYDPIPFSLKRGAGCSLAIRGEGIKFGSRGPIKQFFGSDRSRPSHADYDGKRRLSLFSKYAGDLADLTEEQWNRTVSAFAEDEVRRATLANIQDFLSISHEKYAERLKKRIESIEEPVSASKLEAYLSAIFETFVQQREALASNFLMRLVESVALLISLEEKSPRVEFRVARYLAESKEGFNRKAM

SEQ ID NO: 356 - protein, 413 aa, Artificial Sequence
  Synthetic sequence
VVITQSELYKERLLRVMEIKNDRGRKEPRESQGLVLRFTQVTGGQEKVKQKLWLIFEGFSGTNQASWNFGQPAGGRKPNSGDALKGPKSRVTYETVVFHFGLRLLSAVIERHNLKQQRQTMAYMKRRAAARKKWARSGKKCSRMRNEVEKIKPKWHKDPRWFDIVKEGEPSIVGISSAGFAIYIVEEPNFPRQDPLEIEYAISIWFRRDRSQYLTFKKIQKAEKLKELQYNPIPFRLKQEKTSLVFESGDIKFGSRGSIEHFRDEARGKPPKADMDNNRRLTMFSVFSGNLTNLTEEQYARPVSGLLAPDEKRMPTLLKKLQDFFTPIHEKYGERIKQRLANSEASKRPFKKLEEYLPAIYLEFRARREGLASNWVLVLINSVRTLVRIKSEDPYIEFKVSQYLLEKEDNKAL

SEQ ID NO: 357 - protein, 449 aa, Artificial Sequence
  Synthetic sequence
KQDALFEERLKKAIFIKRQADPLQREELSLLPPNRKIVTGGHESAKDTLKQILRAINGTNQASWNPGTPSGKRDSKSADALAGPKSRVKLETVVFHVGHRLLKKVVEYQGHQKQQHGLKAFMRTCAAMRKKWKRSGKVVGELREQLANIQPKWHYDSRPLNLCFEGKPSVVGLRSAGIALYTIQKSVVPVKEPKPIEYAVSIWFRGPKAMDREDRCLEFKKLKIATELRKLQFEPIVSTLTQGIKGFSLYIQGNSVKFGSRGPIKYFSNESVRQRPPKADPDGNKRLALFSKFSGDLSDLTEEQWNRPILAFEGIIRRATLGNIQDYLTVGHEQFAISLEQLLSEKESVLQMSIEQQRLKKNLGKKAENEWVESFGAEQARKKAQGIREYISGFFQEYCSQREQWAENWVQQLNKSVRLFLTIQDSTPFIEFRVARYLPKGEKKKGKAM

SEQ ID NO: 358 - protein, 711 aa, Artificial Sequence
  Synthetic sequence
ANHAERHKRLRKEANRAANRNRPLVADCDTGDPLVGICRLLRRGDKMQPNKTGCRSCEQVEPELRDAILVSGPGRLDNYKYELFQRGRAMAVHRLLKRVPKLNRPKKAAGNDEKKAENKKSEIQKEKQKQRRMMPAVSMKQVSVADFKHVIENTVRHLFGDRRDREIAECAALRAASKYFLKSRRVRPRKLPKLANPDHGKELKGLRLREKRAKLKKEKEKQAELARSNQKGAVLHVATLKKDAPPMPYEKTQGRNDYTTFVISAAIKVGATRGTKPLLTPQPREWQCSLYWRDGQRWIRGGLLGLQAGIVLGPKLNRELLEAVLQRPIECRMSGCGNPLQVRGAAVDFFMTTNPFYVSGAAYAQKKFKPFGTKRASEDGAAAKAREKLMTQLAKVLDKVVTQAAHSPLDGIWETRPEAKLRAMIMALEHEWIFLRPGPCHNAAEEVIKCDCTGGHAILWALIDEARGALEHKEFYAVTRAHTHDCEKQKLGGRLAGFLDLLIAQDVPLDDAPAARKIKTLLEATPPAPCYKAATSIATCDCEGKFDKLWAIIDATRAGHGTEDLWARTLAYPQNVNCKCKAGKDLTHRLADFLGLLIKRDGPFRERPPHKVTGDRKLVFSGDKKCKGHQYVILAKAHNEEVVRAWISRWGLKSRTNKAGYAATELNLLLNWLSICRRRWMDMLTVQRDTPYIRMKTGRLVVDDKKERKAM

SEQ ID NO: 359 - protein, 574 aa, Artificial Sequence
  Synthetic sequence
AKQREALRVALERGIVRASNRTYTLVTNCTKGGPLPEQCRMIERGKARAMKWEPKLVGCGSCAAATVDLPAIEEYAQPGRLDVAKYKLTTQILAMATRRMMVRAAKLSRRKGQWPAKVQEEKEEPPEPKKMLKAVEMRPVAIVDFNRVIQTTIEHLWAERANADEAELKALKAAAAYFGPSLKIRARGPPKAAIGRELKKAHRKKAYAERKKARRKRAELARSQARGAAAHAAIRERDIPPMAYERTQGRNDVTTIPIAAAIKIAATRGARPLPAPKPMKWQCSLYWNEGQRWIRGGMLTAQAYAHAANIHRPMRCEMWGVGNPLKVRAFEGRVADPDGAKGRKAEFRLQTNAFYVSGAAYRNKKFKPFGTDRGGIGSARKKRERLMAQLAKILDKVVSQAAHSPLDDIWHTRPAQKLRAMIKQLEHEWMFLRPQAPTVEGTKPDVDVAGNMQRQIKALMAPDLPPIEKGSPAKRFTGDKRKKGERAVRVAEAHSDEVVTAWISRWGIQTRRNEGSYAAQELELLLNWLQICRRRWLDMTAAQRVSPYIRMKSGRMITDAADEGVAPIPLVENM

SEQ ID NO: 360 - protein, 743 aa, Artificial Sequence
  Synthetic sequence
KSISGRSIKHMACLKDMLKSEITEIEEKQKKESLRKWDYYSKFSDEILFRRNLNVSANHDANACYGCNPCAFLKEVYGFRIERRNNERIISYRRGLAGCKSCVQSTGYPPIEFVRRKFGADKAMEIVREVLHRRNWGALARNIGREKEADPILGELNELLLVDARPYFGNKSAANETNLAFNVITRAAKKFRDEGMYDIHKQLDIHSEEGKVPKGRKSRLIRIERKHKAIHGLDPGETWRYPHCGKGEKYGVWLNRSRLIHIKGNEYRCLTAFGTTGRRMSLDVACSVLGHPLVKKKRKKGKKTVDGTELWQIKKATETLPEDPIDCTFYLYAAKPTKDPFILKVGSLKAPRWKKLHKDFFEYSDTEKTQGQEKGKRVVRRGKVPRILSLRPDAKFKVSIWDDPYNGKNKEGTLLRMELSGLDGAKKPLILKRYGEPNTKPKNFVFWRPHITPHPLTFTPKHDFGDPNKKTKRRRVFNREYYGHLNDLAKMEPNAKFFEDREVSNKKNPKAKNIRIQAKESLPNIVAKNGRWAAFDPNDSLWKLYLHWRGRRKTIKGGISQEFQEFKERLDLYKKHEDESEWKEKEKLWENHEKEWKKTLEIHGSIAEVSQRCVMQSMMGPLDGLVQKKDYVHIGQSSLKAADDAWTFSANRYKKATGPKWGKISVSNLLYDANQANAELISQSISKYLSKQKDNQGCEGRKMKFLIKIIEPLRENFVKHTRWLHEMTQKDCEVRAQFSRVSM

SEQ ID NO: 361 - protein, 769 aa, Artificial Sequence
  Synthetic sequence
FPSDVGADALKHVRMLQPRLTDEVRKVALTRAPSDRPALARFAAVAQDGLAFVRHLNVSANHDSNCTFPRDPRDPRRGPCEPNPCAFLREVWGFRIVARGNERALSYRRGLAGCKSCVQSTGFPSVPFHRIGADDCMRKLHEILKARNWRLLARNIGREREADPLLTELSEYLLVDARTYPDGAAPNSGRLAENVIKRAAKKFRDEGMRDIHAQLRVHSREGKVPKGRLQRLRRIERKHRAIHALDPGPSWEAEGSARAEVQGVAVYRSQLLRVGHHTQQIEPVGIVARTLFGVGRTDLDVAVSVLGAPLTKRKKGSKTLESTEDFRIAKARETRAEDKIEVAFVLYPTASLLRDEIPKDAFPAMRIDRFLLKVGSVQADREILLQDDYYRFGDAEVKAGKNKGRTVTRPVKVPRLQALRPDAKFRVNVWADPFGAGDSPGTLLRLEVSGVTRRSQPLRLLRYGQPSTQPANFLCWRPHRVPDPMTFTPRQKFGERRKNRRTRRPRVFERLYQVHIKHLAHLEPNRKWFEEARVSAQKWAKARAIRRKGAEDIPVVAPPAKRRWAALQPNAELWDLYAHDREARKRFRGGRAAEGEEFKPRLNLYLAHEPEAEWESKRDRWERYEKKWTAVLEEHSRMCAVADRTLPQFLSDPLGARMDDKDYAFVGKSALAVAEAFVEEGTVERAQGNCSITAKKKFASNASRKRLSVANLLDVSDKADRALVFQAVRQYVQRQAENGGVEGRRMAFLRKLLAPLRQNFVCHTRWLHM

SEQ ID NO: 362 - protein, 564 aa, Artificial Sequence
  Synthetic sequence
AARKKKRGKIGITVKAKEKSPPAAGPFMARKLVNVAANVDGVEVHLCVECEADAHGSASARLLGGCRSCTGSIGAEGRLMGSVDVDRERVIAEPVHTETERLGPDVKAFEAGTAESKYAIQRGLEYWGVDLISRNRARTVRKMEEADRPESSTMEKTSWDEIAIKTYSQAYHASENHLFWERQRRVRQHALALFRRARERNRGESPLQSTQRPAPLVLAALHAEAAAISGRARAEYVLRGPSANVRAAAADIDAKPLGHYKTPSPKVARGFPVKRDLLRARHRIVGLSRAYFKPSDVVRGTSDAIAHVAGRNIGVAGGKPKEIEKTFTLPFVAYWEDVDRVVHCSSFKADGPWVRDQRIKIRGVSSAVGTFSLYGLDVAWSKPTSFYIRCSDIRKKFHPKGFGPMKHWRQWAKELDRLTEQRASCVVRALQDDEELLQTMERGQRYYDVFSCAATHATRGEADPSGGCSRCELVSCGVAHKVTKKAKGDTGIEAVAVAGCSLCESKLVGPSKPRVHRQMAALRQSHALNYLRRLQREWEALEAVQAPTPYLRFKYARHLEVRSM

SEQ ID NO: 363 - protein, 565 aa, Artificial Sequence
  Synthetic sequence
AAKKKKQRGKIGISVKPKEGSAPPADGPFMARKLVNVAANVDGVEVNLCIECEADAHGSAPARLLGGCKSCTGSIGAEGRLMGSVDVDRADAIAKPVNTETEKLGPDVQAFEAGTAETKYALQRGLEYWGVDLISRNRSRTVRRTEEGQPESATMEKTSWDEIAIKSYTRAYHASENHLFWERQRRVRQHALALFKRAKERNRGDSTLPREPGHGLVAIAALACEAYAVGGRNLAETVVRGPTFGTARAVRDVEIASLGRYKTPSPKVAHGSPVKRDFLRARHRIVGLARAYYRPSDVVRGTSDAIAHVAGRNIGVAGGKPRAVEAVFTLPFVAYWEDVDRVVHCSSFQVSAPWNRDQRMKIAGVTTAAGTFSLHGGELKWAKPTSFYIRCSDTRRKFRPKGFGPMKRWRQWAKDLDRLVEQRASCVVRALQDDAALLETMERGQRYYDVFACAVTHATRGEADRLAGCSRCALTPCQEAHRVTTKPRGDAGVEQVQTSDCSLCEGKLVGPSKPRLHRTLTLLRQEHGLNYLRRLQREWESLEAVQVPTPYLRFKYARHLEVRSM

SEQ ID NO: 364 - protein, 499 aa, Artificial Sequence
  Synthetic sequence
TDSQSESVPEVVYALTGGEVPGRVPPDGGSAEGARNAPTGLRKQRGKIKISAKPSKPGSPASSLARTLVNEAANVDGVQSSGCATCRMRANGSAPRALPIGCVACASSIGRAPQEETVCALPTTQGPDVRLLEGGHALRKYDIQRALEYWGVDLIGRNLDRQAGRGMEPAEGATATMKRVSMDELAVLDFGKSYYASEQHLFAARQRRVRQHAKALKIRAKHANRSGSVKRALDRSRKQVTALAREFFKPSDVVRGDSDALAHVVGRNLGVSRHPAREIPQTFTLPLCAYWEDVDRVISCSSLLAGEPFARDQEIRIEGVSSALGSLRLYRGAIEWHKPTSLYIRCSDTRRKFRPRGGLKKRWRQWAKDLDRLVEQRACCIVRSLQADVELLQTMERAQRFYDVHDCAATHVGPVAVRCSPCAGKQFDWDRYRLLAALRQEHALNYLRRLQREWESLEAQQVKMPYLRFKYARKLEVSGPLIGLEVRREPSMGTAIAEM

SEQ ID NO: 365 - protein, 358 aa, Artificial Sequence
  Synthetic sequence
AGTAGRRHGSLGARRSINIAGVTDRHGRWGCESCVYTRDQAGNRARCAPCDQSTYAPDVQEVTIGQRQAKYTIFLTLQSFSWTNTMRNNKRAAAGRSKRTTGKRIGQLAEIKITGVGLAHAHNVIQRSLQHNITKMWRAEKGKSKRVARLKKAKQLTKRRAYFRRRMSRQSRGNGFFRTGKGGIHAVAPVKIGLDVGMIASGSSEPADEQTVTLDAIWKGRKKKIRLIGAKGELAVAACRFREQQTKGDKCIPLILQDGEVRWNQNNWQCHPKKLVPLCGLEVSRKFVSQADRLAQNKVASPLAARFDKTSVKGTLVESDFAAVLVNVTSIYQQCHAMLLRSQEPTPSLRVQRTITSM

SEQ ID NO: 366 - protein, 369 aa, Artificial Sequence
  Synthetic sequence
GVRFSPAQSQVFFRTVIPQSVEARFAINMAAIHDAAGAFGCSVCRFEDRTPRNAKAVHGCSPCTRSTNRPDVFVLPVGAIKAKYDVFMRLLGFNWTHLNRRQAKRVTVRDRIGQLDELAISMLTGKAKAVLKKSICHNVDKSFKAMRGSLKKLHRKASKTGKSQLRAKLSDLRERTNTTQEGSHVEGDSDVALNKIGLDVGLVGKPDYPSEESVEVVVCLYFVGKVLILDAQGRIRDMRAKQYDGFKIPIIQRGQLTVLSVKDLGKWSLVRQDYVLAGDLRFEPKISKDRKYAECVKRIALITLQASLGFKERIPYYVTKQVEIKNASHIAFVTEAIQNCAENFREMTEYLMKYQEKSPDLKVLLTQLM

SEQ ID NO: 367 - protein, 486 aa, Artificial Sequence
  Synthetic sequence
RAVVGKVFLEQARRALNLATNFGTNHRTGCNGCYVTPGKLSIPQDGEKNAAGCTSCLMKATASYVSYPKPLGEKVAKYSTLDALKGFPWYSLRLNLRPNYRGKPINGVQEVAPVSKFRLAEEVIQAVQRYHFTELEQSFPGGRRRLRELRAFYTKEYRRAPEQRQHVVNGDRNIVVVTVLHELGFSVGMFNEVELLPKTPIECAVNVFIRGNRVLLEVRKPQFDKERLLVESLWKKDSRRHTAKWTPPNNEGRIFTAEGWKDFQLPLLLGSTSRSLRAIEKEGFVQLAPGRDPDYNNTIDEQHSGRPFLPLYLYLQGTISQEYCVFAGTWVIPFQDGISPYSTKDTFQPDLKRKAYSLLLDAVKHRLGNKVASGLQYGRFPAIEELKRLVRMHGATRKIPRGEKDLLKKGDPDTPEWWLLEQYPEFWRLCDAAAKRVSQNVGLLLSLKKQPLWQRRWLESRTRNEPLDNLPLSMALTLHLTNEEAL

SEQ ID NO: 368 - DNA, 37 bp, Artificial Sequence
  Synthetic sequence
cttgcagaacccggatagacgaatgaaggaatgcaac

SEQ ID NO: 369 - DNA, 59 bp, Artificial Sequence
  Synthetic sequence
ctacgccgattatcttctgacaactttcgcaagcggtgtaaggtaaaaaatgcgggcac

SEQ ID NO: 370 - DNA, 37 bp, Artificial Sequence
  Synthetic sequence
cttgcaggccttgaatagaggagttaaggaatgcaac

SEQ ID NO: 371 - DNA, 37 bp, Artificial Sequence
  Synthetic sequence
gttgcacagtgctaattagagaaactaggaatgcaac

SEQ ID NO: 372 - DNA, 37 bp, Artificial Sequence
  Synthetic sequence
ctagcatattcagaacaaagggattaaggaatgcaac

SEQ ID NO: 373 - DNA, 37 bp, Artificial Sequence
  Synthetic sequence
ctttcatattcagaaactaggggttaaggactgcaac

SEQ ID NO: 374 - DNA, 37 bp, Artificial Sequence
  Synthetic sequence
gttgcatccctacgtcgtgagcaccggtgagtgcaac

SEQ ID NO: 375 - DNA, 31 bp, Artificial Sequence
  Synthetic sequence
ggaaaggaatcccctgaaggaaacgaggggg

SEQ ID NO: 376 - DNA, 36 bp, Artificial Sequence
  Synthetic sequence
gtgtccatcaatcagatttgcgttggccggtgcaat

SEQ ID NO: 377 - DNA, 37 bp, Artificial Sequence
  Synthetic sequence
gtttcagcgcacgaattaacgagatgagagatgcaac

SEQ ID NO: 378 - DNA, 35 bp, Artificial Sequence
  Synthetic sequence
cttttagacagtttaaattctaaagggtataaaac

SEQ ID NO: 379 - DNA, 59 bp, Artificial Sequence
  Synthetic sequence
gtgcccgcattttttaccttacaccgcttgcgaaagttgtcagaagataatcggcgtag

SEQ ID NO: 380 - DNA, 90 bp, Artificial Sequence
  Synthetic sequence
tttatatgtttctcctggagataacgcaatcgtgacaactttcgcaagcggtgtaaggtagcaggcttccgaattccgcgtttttacggc

SEQ ID NO: 381 - DNA, 90 bp, Artificial Sequence
  Synthetic sequence
gccgtaaaaacgcggaattcggaagcctgctaccttacaccgcttgcgaaagttgtcacgattgcgttatctccaggagaaacatataaa

SEQ ID NO: 382 - DNA, 56 bp, Artificial Sequence
  Synthetic sequence
gatcttcagctatacattattgcaccaacactaaggcagagtatgtttacctggac

SEQ ID NO: 383 - DNA, 56 bp, Artificial Sequence
  Synthetic sequence
gatcttcagctttgtattactggaaggatgcttgcttgaggtgtaaaaacctggac

SEQ ID NO: 384 - DNA, 5 bp, Artificial Sequence
  Synthetic sequence
ttttt

SEQ ID NO: 385 - DNA, 6 bp, Artificial Sequence
  Synthetic sequence
tttttt

SEQ ID NO: 386 - DNA, 7 bp, Artificial Sequence
  Synthetic sequence
ttttttt

SEQ ID NO: 387 - DNA, 8 bp, Artificial Sequence
  Synthetic sequence
tttttttt

SEQ ID NO: 388 - DNA, 9 bp, Artificial Sequence
  Synthetic sequence
ttttttttt

SEQ ID NO: 389 - DNA, 10 bp, Artificial Sequence
  Synthetic sequence
tttttttttt

SEQ ID NO: 390 - DNA, 11 bp, Artificial Sequence
  Synthetic sequence
ttttttttttt

SEQ ID NO: 391 - DNA, 12 bp, Artificial Sequence
  Synthetic sequence
tttttttttttt

SEQ ID NO: 392 - DNA, 55 bp, Artificial Sequence
  Synthetic sequence
gccggggtggtgcccatcctggtcgagctggacggcgacgtaaacggccacaagc

SEQ ID NO: 393 - DNA, 55 bp, Artificial Sequence
  Synthetic sequence
gccggggtggtgcccatcctggtcgagctggacggcgacgtgctcggccacaagc

SEQ ID NO: 394 - DNA, 55 bp, Artificial Sequence
  Synthetic sequence
gccggggtggtgcccatcctggtcgagctggacggcgagctaaacggccacaagc

SEQ ID NO: 395 - DNA, 55 bp, Artificial Sequence
  Synthetic sequence
gccggggtggtgcccatcctggtcgagctggacggcctcgtaaacggccacaagc

SEQ ID NO: 396 - DNA, 55 bp, Artificial Sequence
  Synthetic sequence
gccggggtggtgcccatcctggtcgagctggacgcggacgtaaacggccacaagc

SEQ ID NO: 397 - DNA, 55 bp, Artificial Sequence
  Synthetic sequence
gccggggtggtgcccatcctggtcgagctggagcgcgacgtaaacggccacaagc

SEQ ID NO: 398 - DNA, 55 bp, Artificial Sequence
  Synthetic sequence
gccggggtggtgcccatcctggtcgagctgctcggcgacgtaaacggccacaagc

SEQ ID NO: 399 - DNA, 55 bp, Artificial Sequence
  Synthetic sequence
gccggggtggtgcccatcctggtcgagcacgacggcgacgtaaacggccacaagc

SEQ ID NO: 400 - DNA, 55 bp, Artificial Sequence
  Synthetic sequence
gccggggtggtgcccatcctggtcgacgtggacggcgacgtaaacggccacaagc

SEQ ID NO: 401 - DNA, 55 bp, Artificial Sequence
  Synthetic sequence
gccggggtggtgcccatcctggtcctgctggacggcgacgtaaacggccacaagc

SEQ ID NO: 402 - DNA, 55 bp, Artificial Sequence
  Synthetic sequence
gccggggtggtgcccatcctggaggagctggacggcgacgtaaacggccacaagc

SEQ ID NO: 403 - DNA, 55 bp, Artificial Sequence
  Synthetic sequence
gccggggtggtgcccatcctcctcgagctggacggcgacgtaaacggccacaagc

SEQ ID NO: 404 - DNA, 34 bp, Artificial Sequence
  Synthetic sequence
gtgttaatacaaaggtacaggaacaaagaatttg

SEQ ID NO: 405 - DNA, 18 bp, Artificial Sequence
  Synthetic sequence
caaagagaagcctcggcc

SEQ ID NO: 406 - DNA, 55 bp, Artificial Sequence
  Synthetic sequence
tttattcaaggcaatcactatcagctgtggaacacccaggtaaactaacacaact

SEQ ID NO: 407 - DNA, 55 bp, Artificial Sequence
  Synthetic sequence
tttattcaaggcaatcactatcagctgtggaacacccaggtgctctaacacaact

SEQ ID NO: 408 - DNA, 55 bp, Artificial Sequence
  Synthetic sequence
tttattcaaggcaatcactatcagctgtggaacacccacctaaactaacacaact

SEQ ID NO: 409 - DNA, 55 bp, Artificial Sequence
  Synthetic sequence
tttattcaaggcaatcactatcagctgtggaacaccgtggtaaactaacacaact

SEQ ID NO: 410 - DNA, 55 bp, Artificial Sequence
  Synthetic sequence
tttattcaaggcaatcactatcagctgtggaacaggcaggtaaactaacacaact

SEQ ID NO: 411 - DNA, 55 bp, Artificial Sequence
  Synthetic sequence
tttattcaaggcaatcactatcagctgtggaagtcccaggtaaactaacacaact

SEQ ID NO: 412 - DNA, 55 bp, Artificial Sequence
  Synthetic sequence
tttattcaaggcaatcactatcagctgtggttcacccaggtaaactaacacaact

SEQ ID NO: 413 - DNA, 55 bp, Artificial Sequence
  Synthetic sequence
tttattcaaggcaatcactatcagctgtccaacacccaggtaaactaacacaact

SEQ ID NO: 414 - DNA, 55 bp, Artificial Sequence
  Synthetic sequence
tttattcaaggcaatcactatcagctcaggaacacccaggtaaactaacacaact

SEQ ID NO: 415 - DNA, 55 bp, Artificial Sequence
  Synthetic sequence
tttattcaaggcaatcactatcaggagtggaacacccaggtaaactaacacaact

SEQ ID NO: 416 - DNA, 55 bp, Artificial Sequence
  Synthetic sequence
tttattcaaggcaatcactatctcctgtggaacacccaggtaaactaacacaact

SEQ ID NO: 417 - DNA, 55 bp, Artificial Sequence
  Synthetic sequence
tttattcaaggcaatcactaagagctgtggaacacccaggtaaactaacacaact

SEQ ID NO: 418 - DNA, 59 bp, Artificial Sequence
  Synthetic sequence
ctacgccgattatcttctgacaactttcgcaagcggtgtaaggcgaaaaatgcgggcac

SEQ ID NO: 419 - DNA, 59 bp, Artificial Sequence
  Synthetic sequence
ctacgccgattatcttctgacaactttcgcaagcggtgtaaaataaaaaatgcgggcac

SEQ ID NO: 420 - DNA, 59 bp, Artificial Sequence
  Synthetic sequence
ctacgccgattatcttctgacaactttcgcaagcggtgtggggtaaaaaatgcgggcac

SEQ ID NO: 421 - DNA, 59 bp, Artificial Sequence
  Synthetic sequence
ctacgccgattatcttctgacaactttcgcaagcggtacaaggtaaaaaatgcgggcac

SEQ ID NO: 422 - DNA, 59 bp, Artificial Sequence
  Synthetic sequence
ctacgccgattatcttctgacaactttcgcaagcgacgtaaggtaaaaaatgcgggcac

SEQ ID NO: 423 - DNA, 59 bp, Artificial Sequence
  Synthetic sequence
ctacgccgattatcttctgacaactttcgcaagtagtgtaaggtaaaaaatgcgggcac

SEQ ID NO: 424 - DNA, 59 bp, Artificial Sequence
  Synthetic sequence
ctacgccgattatcttctgacaactttcgcagacggtgtaaggtaaaaaatgcgggcac

SEQ ID NO: 425 - DNA, 59 bp, Artificial Sequence
  Synthetic sequence
ctacgccgattatcttctgacaactttcgtgagcggtgtaaggtaaaaaatgcgggcac

SEQ ID NO: 426 - DNA, 59 bp, Artificial Sequence
  Synthetic sequence
ctacgccgattatcttctgacaacttttacaagcggtgtaaggtaaaaaatgcgggcac

SEQ ID NO: 427 - DNA, 59 bp, Artificial Sequence
  Synthetic sequence
ctacgccgattatcttctgacaactcccgcaagcggtgtaaggtaaaaaatgcgggcac

SEQ ID NO: 428 - DNA, 59 bp, Artificial Sequence
  Synthetic sequence
ctacgccgattatcttctgacaatcttcgcaagcggtgtaaggtaaaaaatgcgggcac

SEQ ID NO: 429 - DNA, 59 bp, Artificial Sequence
  Synthetic sequence
ctacgccgattatcttctgacggctttcgcaagcggtgtaaggtaaaaaatgcgggcac

SEQ ID NO: 430 - DNA, 59 bp, Artificial Sequence
  Synthetic sequence
ctacgccgattatcttctggtaactttcgcaagcggtgtaaggtaaaaaatgcgggcac

SEQ ID NO: 431 - DNA, 49 bp, Artificial Sequence
  Synthetic sequence
tatcttctgacaactttcgcaagcggtgtaaggtaaaaaatgcgggcac

SEQ ID NO: 432 - DNA, 44 bp, Artificial Sequence
  Synthetic sequence
tctgacaactttcgcaagcggtgtaaggtaaaaaatgcgggcac

SEQ ID NO: 433 - DNA, 39 bp, Artificial Sequence
  Synthetic sequence
caactttcgcaagcggtgtaaggtaaaaaatgcgggcac

SEQ ID NO: 434 - DNA, 34 bp, Artificial Sequence
  Synthetic sequence
ttcgcaagcggtgtaaggtaaaaaatgcgggcac

SEQ ID NO: 435 - DNA, 54 bp, Artificial Sequence
  Synthetic sequence
ctacgccgattatcttctgacaactttcgcaagcggtgtaaggtaaaaaatgcg

SEQ ID NO: 436 - DNA, 49 bp, Artificial Sequence
  Synthetic sequence
ctacgccgattatcttctgacaactttcgcaagcggtgtaaggtaaaaa

SEQ ID NO: 437 - DNA, 40 bp, Artificial Sequence
  Synthetic sequence
ctacgccgattatcttctgacaactttcgcaagcggtgta

SEQ ID NO: 438 - DNA, 35 bp, Artificial Sequence
  Synthetic sequence
ctacgccgattatcttctgacaactttcgcaagcg

SEQ ID NO: 439 - DNA, 30 bp, Artificial Sequence
  Synthetic sequence
ctacgccgattatcttctgacaactttcgc

SEQ ID NO: 440 - DNA, 25 bp, Artificial Sequence
  Synthetic sequence
ctacgccgattatcttctgacaact

SEQ ID NO: 441 - DNA, 20 bp, Artificial Sequence
  Synthetic sequence
ctacgccgattatcttctga

SEQ ID NO: 442 - DNA, 34 bp, Artificial Sequence
  Synthetic sequence
caactttcgcaagcggtgtaaggtaaaaaatgcg

SEQ ID NO: 443 - DNA, 63 bp, Artificial Sequence
  Synthetic sequence
atggaatgtggcgaacgctttcaacgaaacaactttcgcaagcggtgtaaggtaaaaaatgcg

SEQ ID NO: 444 - DNA, 63 bp, Artificial Sequence
  Synthetic sequence
atggaatgtggcgaacgcttagttggaaacaactttcgcaagcggtgtaaggtaaaaaatgcg

SEQ ID NO: 445 - DNA, 63 bp, Artificial Sequence
  Synthetic sequence
atggaatgtggcgaagcgaaagttggaaacaactttcgcaagcggtgtaaggtaaaaaatgcg

SEQ ID NO: 446 - DNA, 63 bp, Artificial Sequence
  Synthetic sequence
atggaatgtgcgcttgcgaaagttggaaacaactttcgcaagcggtgtaaggtaaaaaatgcg

SEQ ID NO: 447 - DNA, 63 bp, Artificial Sequence
  Synthetic sequence
atggatacaccgcttgcgaaagttggaaacaactttcgcaagcggtgtaaggtaaaaaatgcg

SEQ ID NO: 448 - DNA, 63 bp, Artificial Sequence
  Synthetic sequence
taccttacaccgcttgcgaaagttggaaacaactttcgcaagcggtgtaaggtaaaaaatgcg

SEQ ID NO: 449 - DNA, 40 bp, Artificial Sequence
  Synthetic sequence
gttttatcttctgctggtggttcgttcggtatttttaatg

SEQ ID NO: 450 - DNA, 40 bp, Artificial Sequence
  Synthetic sequence
cattaaaaataccgaacgaaccaccagcagaagataaaac

SEQ ID NO: 451 - DNA, 43 bp, Artificial Sequence
  Synthetic sequence
gaccatttgcgaaatgtatctaatggtcaaactaaatctactc

SEQ ID NO: 452 - DNA, 43 bp, Artificial Sequence
  Synthetic sequence
gagtagatttagtttgaccattagatacatttcgcaaatggtc

SEQ ID NO: 453 - DNA, 61 bp, Artificial Sequence
  Synthetic sequence
ctacgccgattatcttctgacaactttcgcaagcggtgtaaggtaaaaaatgcgggcaccc

SEQ ID NO: 454 - DNA, 30 bp, Artificial Sequence
  Synthetic sequence
ggaatgcaactaccttacaccgcttgcgaa

SEQ ID NO: 455 - DNA, 140 bp, Artificial Sequence
  Synthetic sequence
cttcactgataaagtggagaaccgcttcaccaaaagctgtcccttaggggattagaacttgagtgaaggtgggctgcttgcatcagcctaatgtcgagaagtgctttcttcggaaagtaaccctcgaaacaaattcattt

SEQ ID NO: 456 - DNA, 40 bp, Artificial Sequence
  Synthetic sequence
gacgaatgaaggaatgcaactaccttacaccgcttgcgaa

SEQ ID NO: 457 - DNA, 40 bp, Artificial Sequence
  Synthetic sequence
gacgaatgaaggaatgcaacccttacaccgcttgcgaaag

SEQ ID NO: 458 - DNA, 40 bp, Artificial Sequence
  Synthetic sequence
gacgaatgaaggaatgcaacttacaccgcttgcgaaagtt

SEQ ID NO: 459 - DNA, 40 bp, Artificial Sequence
  Synthetic sequence
gacgaatgaaggaatgcaacacaccgcttgcgaaagttgt

SEQ ID NO: 460 - DNA, 41 bp, Artificial Sequence
  Synthetic sequence
gacgaatgaaggaatgcaaccgtcgccgtccagctcgacca

SEQ ID NO: 461 - DNA, 40 bp, Artificial Sequence
  Synthetic sequence
gacgaatgaaggaatgcaacgatcgttacgctaactatga

SEQ ID NO: 462 - DNA, 180 bp, Artificial Sequence
  Synthetic sequence
ttcactgataaagtggagaaccgcttcaccaaaagctgtcccttaggggattagaacttgagtgaaggtgggctgcttgcatcagcctaatgtcgagaagtgctttcttcggaaagtaaccctcgaaacaaattcatttgaaagaatgaaggaatgcaacacttgacacttaatgctcaa

SEQ ID NO: 463 - DNA, 44 bp, Artificial Sequence
  Synthetic sequence
gggtaatttctactaagtgtagatacttgacacttaatgctcaa

SEQ ID NO: 464 - DNA, 45 bp, Artificial Sequence
  Synthetic sequence
gacgaatgaaggaatgcaactaccttacaccgcttgcgaaagttg

SEQ ID NO: 465 - DNA, 40 bp, Artificial Sequence; identical to SEQ ID NO: 456
  Synthetic sequence

SEQ ID NO: 466 - DNA, 38 bp, Artificial Sequence
  Synthetic sequence
gacgaatgaaggaatgcaactaccttacaccgcttgcg

SEQ ID NO: 467 - DNA, 36 bp, Artificial Sequence
  Synthetic sequence
gacgaatgaaggaatgcaactaccttacaccgcttg

SEQ ID NO: 468 - DNA, 34 bp, Artificial Sequence
  Synthetic sequence
gacgaatgaaggaatgcaactaccttacaccgct

SEQ ID NO: 469 - DNA, 32 bp, Artificial Sequence
  Synthetic sequence
gacgaatgaaggaatgcaactaccttacaccg

SEQ ID NO: 470 - DNA, 30 bp, Artificial Sequence
  Synthetic sequence
gacgaatgaaggaatgcaactaccttacac

SEQ ID NO: 471 - DNA, 57 bp, Artificial Sequence
  Synthetic sequence
gttgcagaacccgaatagacgaatgaaggaatgcaactaccttacaccgcttgcgaa

SEQ ID NO: 472 - DNA, 40 bp, Artificial Sequence; identical to SEQ ID NO: 456
  Synthetic sequence

SEQ ID NO: 473 - DNA, 37 bp, Artificial Sequence
  Synthetic sequence
gaatgaaggaatgcaactaccttacaccgcttgcgaa

SEQ ID NO: 474 - DNA, 35 bp, Artificial Sequence
  Synthetic sequence
atgaaggaatgcaactaccttacaccgcttgcgaa

SEQ ID NO: 475 - DNA, 30 bp, Artificial Sequence; identical to SEQ ID NO: 454
  Synthetic sequence

SEQ ID NO: 476 - DNA, 179 bp, Artificial Sequence
  Synthetic sequence
cttcactgataaagtggagaaccgcttcaccaaaagctgtcccttaggggattagaacttgagtgaaggtgggctgcttgcatcagcctaatgtcgagaagtgctttcttcggaaagtaaccctcgaaacaaattcatttttcctctccaattctgcacaaaaaaaggtgagtccttat

SEQ ID NO: 477 - DNA, 140 bp, Artificial Sequence; identical to SEQ ID NO: 455
  Synthetic sequence

SEQ ID NO: 478 - DNA, 110 bp, Artificial Sequence
  Synthetic sequence
cttcactgataaagtggagaaccgcttcaccaaaagctgtcccttaggggattagaacttgagtgaaggtgggctgcttgcatcagcctaatgtcgagaagtgctttctt

SEQ ID NO: 479 - DNA, 72 bp, Artificial Sequence
  Synthetic sequence
cttcactgataaagtggagaaccgcttcaccaaaagctgtcccttaggggattagaacttgagtgaaggtgg

SEQ ID NO: 480 - DNA, 136 bp, Artificial Sequence
  Synthetic sequence
ttcactgataaagtggagaaccgcttcaccaaaagctgtcccttaggggattagaacttgagtgaaggtgggctgcttgcatcagcctaatgtcgagaagtgctttcttcggaaagtaaccctcgaaacaaattca

SEQ ID NO: 481 - DNA, 234 bp, Artificial Sequence
  Synthetic sequence
ttcacacttcactgataaagtggagaaccgcttcaccaaaagctgtcccttaggggattagaacttgagtgaaggtgggctgcttgcatcagcctaatgtcgagaagtgctttcttcggaaagtaaccctcgaaacaaattcatttttcctctccaattctgcacaaaaaaaggtgagtccttataaaccggcgtgcagaacgccggctcaccttttttcttcattcgatttta

SEQ ID NO: 482 - DNA, 181 bp, Artificial Sequence
  Synthetic sequence
cttcactgataaagtggagaaccgcttcaccaaaagctgtcccttaggggattagaacttgagtgaaggtgggctgcttgcatcagcctaatgtcgagaagtgctttcttcggaaagtaaccctcgaaacaaattcatttgaaagaatgaaggaatgcaactaccttacaccgcttgcgaa

SEQ ID NO: 483 - DNA, 222 bp, Artificial Sequence
  Synthetic sequence
cttcactgataaagtggagaaccgcttcaccaaaagctgtcccttaggggattagaacttgagtgaaggtgggctgcttgcatcagcctaatgtcgagaagtgctttcttcggaaagtaaccctcgaaacaaattcatttttcctctccaattctgcacaagaaagttgcagaacccgaatagacgaatgaaggaatgcaactaccttacaccgcttgcgaa

SEQ ID NO: 484 - DNA, 45 bp, Artificial Sequence
  Synthetic sequence
gacgaatgaaggaatgcaactaccgaacgaaccaccagcagaaga

SEQ ID NO: 485 - DNA, 45 bp, Artificial Sequence
  Synthetic sequence
gacgaatgaaggaatgcaactcttctgctggtggttcgttcggta

SEQ ID NO: 486 - DNA, 43 bp, Artificial Sequence
  Synthetic sequence
gacgaatgaaggaatgcaacgtttgaccattagatacatttcg

SEQ ID NO: 487 - DNA, 43 bp, Artificial Sequence
  Synthetic sequence
gacgaatgaaggaatgcaaccgaaatgtatctaatggtcaaac

SEQ ID NO: 488 - protein, 400 aa, Artificial Sequence
  Synthetic sequence
AAVYSKFYIENHFKMGIPETLSRIRGPSIIQGFSVNENYINIAGVGDRDFIFGCKKCKYTRGKPSSKKINKCHPCKRSTYPEPVIDVRGSISEFKYKIYNKLKQEPNQSIKQNTKGRMNPSDHTSSNDGIIINGIDNRIAYNVIFSSYKHLMEKQINLLRDTTKRKARQIKKYNNSGKKKHSLRSQTKGNLKNRYHMLGMFKKGSLTITNEGDFITAVRKVGLDISLYKNESLNKQEVETELCLNIKWGRTKSYTVSGYIPLPINIDWKLYLFEKETGLTLRLFGNKYKIQSKKFLIAQLFKPKRPPCADPVVKKAQKWSALNAHVQQMAGLFSDSHLLKRELKNRMHKQLDFKSLWVGTEDYIKWFEELSRSYVEGAEKSLEFFRQDYFCFNYTKQTTM

SEQ ID NO: 489 - protein, 666 aa, Artificial Sequence
  Synthetic sequence
PQQQRDLMLMAANYDQDYGNGCGPCTVVASAAYRPDPQAQHGCKRHLRTLGASAVTHVGLGDRTATITALHRLRGPAALAARARAAQAASAPMTPDTDAPDDRRRLEAIDADDVVLVGAHRALWSAVRRWADDRRAALRRRLHSEREWLLKDQIRWAELYTLIEASGTPPQGRWRNTLGALRGQSRWRRVLAPTMRATCAETHAELWDALAELVPEMAKDRRGLLRPPVEADALWRAPMIVEGWRGGHSVVVDAVAPPLDLPQPCAWTAVRLSGDPRQRWGLHLAVPPLGQVQPPDPLKATLAVSMRHRGGVRVRTLQAMAVDADAPMQRHLQVPLTLQRGGGLQWGIHSRGVRRREARSMASWEGPPIWTGLQLVNRWKGQGSALLAPDRPPDTPPYAPDAAVAPAQPDTKRARRTLKEACTVCRCAPGHMRQLQVTLTGDGTWRRFRLRAPQGAKRKAEVLKVATQHDERIANYTAWYLKRPEHAAGCDTCDGDSRLDGACRGCRPLLVGDQCFRRYLDKIEADRDDGLAQIKPKAQEAVAAMAAKRDARAQKVAARAAKLSEATGQRTAATRDASHEARAQKELEAVATEGTTVRHDAAAVSAFGSWVARKGDEYRHQVGVLANRLEHGLRLQELMAPDSVVADQQRASGHARVGYRYVLTAM

SEQ ID NO: 490 - protein, 560 aa, Artificial Sequence
  Synthetic sequence
AVAHPVGRGNAGSPGARGPEELPRQLVNRASNVTRPATYGCAPCRHVRLSIPKPVLTGCRACEQTTHPAPKRAVRGGADAAKYDLAAFFAGWAADLEGRNRRRQVHAPLDPQPDPNHEPAVTLQKIDLAEVSIEEFQRVLARSVKHRHDGRASREREKARAYAQVAKKRRNSHAHGARTRRAVRRQTRAVRRAHRMGANSGEILVASGAEDPVPEAIDHAAQLRRRIRACARDLEGLRHLSRRYLKTLEKPCRRPRAPDLGRARCHALVESLQAAERELEELRRCDSPDTAMRRLDAVLAAAASTDATFATGWTVVGMDLGVAPRGSAAPEVSPMEMAISVFWRKGSRRVIVSKPIAGMPIRRHELIRLEGLGTLRLDGNHYTGAGVTKGRGLSEGTEPDFREKSPSTLGFTLSDYRHESRWRPYGAKQGKTARQFFAAMSRELRALVEHQVLAPMGPPLLEAHERRFETLLKGQDNKSIHAGGGGRYVWRGPPDSKKRPAADGDWFRFGRGHADHRGWANKRHELAANYLQSAFRLWSTLAEAQEPTPYARYKYTRVTM

SEQ ID NO: 491 - protein, 404 aa, Artificial Sequence
  Synthetic sequence
WDFLTLQVYERHTSPEVCVAGNSTKCASGTRKSDHTHGVGVKLGAQEINVSANDDRDHEVGCNICVISRVSLDIKGWRYGCESCVQSTPEWRSIVRFDRNHKEAKGECLSRFEYWGAQSIARSLKRNKLMGGVNLDELAIVQNENVVKTSLKHLFDKRKDRIQANLKAVKVRMRERRKSGRQRKALRRQCRKLKRYLRSYDPSDIKEGNSCSAFTKLGLDIGISPNKPPKIEPKVEVVFSLFYQGACDKIVTVSSPESPLPRSWKIKIDGIRALYVKSTKVKFGGRTFRAGQRNNRRKVRPPNVKKGKRKGSRSQFFNKFAVGLDAVSQQLPIASVQGLWGRAETKKAQTICLKQLESNKPLKESQRCLFLADNWVVRVCGFLRALSQRQGPTPYIRYRYRCNM

SEQ ID NO: 492 - protein, 392 aa, Artificial Sequence
  Synthetic sequence
ARNVGQRNASRQSKRESAKARSRRVTGGHASVTQGVALINAAANADRDHTTGCEPCTWERVNLPLQEVIHGCDSCTKSSPFWRDIKVVNKGYREAKEEIMRIASGISADHLSRALSHNKVMGRLNLDEVCILDFRTVLDTSLKHLTDSRSNGIKEHIRAVHRKIRMRRKSGKTARALRKQYFALRRQWKAGHKPNSIREGNSLTALRAVGFDVGVSEGTEPMPAPQTEVVLSVFYKGSATRILRISSPHPIAKRSWKVKIAGIKALKLIRREHDFSFGRETYNASQRAEKRKFSPHAARKDFFNSFAVQLDRLAQQLCVSSVENLWVTEPQQKLLTLAKDTAPYGIREGARFADTRARLAWNWVFRVCGFTRALHQEQEPTPYCRFTWRSKM

SEQ ID NO: 493 - DNA, 7580 bp, Artificial Sequence
  Synthetic sequence
gcaaccgcacctgtggcgccggtgatgccggccacgatgcgtccggcgtagaggatcgagatctcgatcccgcgaaattaatacgactcactatagggagaccacaacggtttccctctagtgccggctccggagagctctttaattaagcggccgccctgcaggactcgagttctagaaataattttgtttaactttaagaaggagatatacatatgaaatcttctcaccatcaccatcaccatcaccatcaccatggttcttctatgaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaattcgagctcgaacaacaacaacaataacaataacaacaacctcgggatcgaggaaaacctgtacttccaatccaatgcaatggaagaaagcattattaccggtgtgaaattcaaactgcgcatcgataaagaaaccaccaaaaaactgaacgagtacttcgatgaatatggcaaagcaattaacttcgccgtgaagatcattcagaaagaactggcagatgatcgttttgcaggtaaagcaaaactggaccagaataaaaacccgatcctggatgaaaacggcaaaaaaatctatgaattcccggatgaattttgcagctgtggtaaacaggttaacaagtacgttaacaacaaaccgttttgccaagagtgctataaaatccgctttaccgaaaatggtattcgcaaacgtatgtatagcgccaaaggtcgtaaagccgaacataaaatcaatatcctgaacagcaccaacaagatcagcaaaacccattttaactatgccattcgcgaagccttcattctggataaaagcatcaaaaagcagcgcaaaaaacgtaatgaacgtctgcgtgaaagtaaaaaacgtctgcagcagtttatcgatatgcgtgatggtaaacgtgaaatttgcccgaccattaaaggtcagaaagtggatcgttttattcatccgagctggatcaccaaagataaaaagctggaagattttcgcggttataccctgagcattatcaacagcaaaattaagattctggatcgcaacatcaaacgcgaagaaaaaagcctgaaagaaaaaggccagatcatctttaaagccaaacgtctgatgctggataaatccattcgttttgttggtgatcgcaaagtgctgtttacaattagtaaaaccctgccgaaagagtatgaactggatctgccgagcaaagaaaaacggctgaattggctgaaagagaagatcgagattatcaagaaccagaaaccgaaatatgcctatctgctgcgcaaaaacattgagagcgaaaaaaaaccgaactatgagtactatctgcagtacaccctggaaattaaaccggaactgaaagatttttatgatggtgccattggtattgaccgtggcattaatcatattgccgtttgcacctttattagcaacgatggtaaagttacccctccgaaatttttcagcagcggtgaaattctgcgtctgaaaaatctgcagaaagagcgtgatcgctttctgctgcgtaaacacaacaaaaatcgcaaaaaaggcaacatgcgcgtgatcgaaaacaaaatcaatctgatcctgcaccgttatagcaagcagattgttgatatggccaaaaagctgaatgccagcattgtttttgaagaactgggtcgtattggtaaaagccgcaccaaaatgaaaaaaagccagcgttataaactgagcctgttcatcttcaagaaactgagcgatctggttgattacaaaagccgtcgtgaaggtattcgtgttacctatgttccgcctgaatataccagcaaagaatgtagccattgcggtgaaaaagttaatacccagcgtccgtttaatggcaactatagcctgtttaaatgcaacaaatgtggcatccagctgaacagcgattataatgcaagcatcaacattgcgaaaaagggcctgaaaattccgaatagcacctaataacattggaagtggataacggatccgcgatcgcggcgcgccacctggtggccggccggtaccacgcgtgcgcgctgatccggctgctaacaaagcccgaaaggaagctgagttggctgctgccaccgctgagcaataactagcataaccccttggggcctctaaacgggtcttgaggggttttttgctgaaaggaggaactatatccggatatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataacattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgcca

SEQ ID NO: 494 - DNA, 4715 bp, Artificial Sequence
  Synthetic sequence
atcgttgatagagttattttaccactccctatcagtgatagagaaaagaattcaaaagatctaaagaggagaaaggatctatggaagaaagcattattaccggtgtgaaattcaaactgcgcatcgataaagaaaccaccaaaaaactgaacgagtacttcgatgaatatggcaaagcaattaacttcgccgtgaagatcattcagaaagaactggcagatgatcgttttgcaggtaaagcaaaactggaccagaataaaaacccgatcctggatgaaaacggcaaaaaaatctatgaattcccggatgaattttgcagctgtggtaaacaggttaacaagtacgttaacaacaaaccgttttgccaagagtgctataaaatccgctttaccgaaaatggtattcgcaaacgtatgtatagcgccaaaggtcgtaaagccgaacataaaatcaatatcctgaacagcaccaacaagatcagcaaaacccattttaactatgccattcgcgaagccttcattctggataaaagcatcaaaaagcagcgcaaaaaacgtaatgaacgtctgcgtgaaagtaaaaaacgtctgcagcagtttatcgatatgcgtgatggtaaacgtgaaatttgcccgaccattaaaggtcagaaagtggatcgttttattcatccgagctggatcaccaaagataaaaagctggaagattttcgcggttataccctgagcattatcaacagcaaaattaagattctggatcgcaacatcaaacgcgaagaaaaaagcctgaaagaaaaaggccagatcatctttaaagccaaacgtctgatgctggataaatccattcgttttgttggtgatcgcaaagtgctgtttacaattagtaaaaccctgccgaaagagtatgaactggatctgccgagcaaagaaaaacggctgaattggctgaaagagaagatcgagattatcaagaaccagaaaccgaaatatgcctatctgctgcgcaaaaacattgagagcgaaaaaaaaccgaactatgagtactatctgcagtacaccctggaaattaaaccggaactgaaagatttttatgatggtgccattggtattgaccgtggcattaatcatattgccgtttgcacctttattagcaacgatggtaaagttacccctccgaaatttttcagcagcggtgaaattctgcgtctgaaaaatctgcagaaagagcgtgatcgctttctgctgcgtaaacacaacaaaaatcgcaaaaaaggcaacatgcgcgtgatcgaaaacaaaatcaatctgatcctgcaccgttatagcaagcagattgttgatatggccaaaaagctgaatgccagcattgtttttgaagaactgggtcgtattggtaaaagccgcaccaaaatgaaaaaaagccagcgttataaactgagcctgttcatcttcaagaaactgagcgatctggttgattacaaaagccgtcgtgaaggtattcgtgttacctatgttccgcctgaatataccagcaaagaatgtagccattgcggtgaaaaagttaatacccagcgtccgtttaatggcaactatagcctgtttaaatgcaacaaatgtggcatccagctgaacagcgattataatgcaagcatcaacattgcgaaaaagggcctgaaaattccgaatagcacctaataatgttggttaagccacaatatggaatattgttcttatggacagtattgacttaaattaataatcttcgaaggctatatgcggaagatttggcgttgttgtaacgcaataaggggtaaccctgaaaaggtttgaaatcatataaacctagttttatttgagtttaggctcagataaaatgaacagaccaatctttaattccgttctgatttaaaaaatcagaatctctttataaatagtattacaaaaagtgtacattccaaaatccgaaagcagaattgacctttttaagcctaaaaaagccaaatttcaaggctctttcatactcagaacaaagggattaaggaatgcaactaccttacaccgcttgcgaaagttgtcagaagataatctttcatactcagaacaaagggattaaggaatgcaactatcttatccatttcttgacatcaaattttcttgcagcatctgaattgcttaattgctttccttgcttcagcaggaaatagccaagattttccagttctgctggcgttattgcaagcacggggattttgtgcttgctgtagattttgttcttcaggaccttctttttccatgctagagtcacactggctcaccttcgggtgggcctttctgcgtttatacctagggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgttactagtgcttggattctcaccaataaaaaacgcccggcggcaaccgagcgttctgaacaaatccagatggagttctgaggtcattactggatctatcaacaggagtccaagcgagctcgatatcaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccagatatcgacgtcttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactct

SEQ ID NO: 495 - DNA, 4670 bp, Artificial Sequence
  Synthetic sequence
taattcctaatttttgttgacactctatcgttgatagagttattttaccactccctatcagtgatagagaaaagaattcaaaagatctaaagaggagaaaggatctatgaaatctcaccatcaccatcaccatgaaaacctgtacttccaatccaatattggaagtggaatggccaaaaacaccattaccaaaacactgaaactgcgtattgtgcgtccgtataatagcgcagaagtggaaaaaattgttgccgacgaaaaaaacaaccgcgaaaaaatcgcactggaaaagaacaaagacaaagtgaaagaagcctgcagcaaacatctgaaagttgcagcatattgtaccacacaggttgaacgtaatgcatgcctgttttgtaaagcacgtaaactggatgacaaattctaccaaaaactgcgtggtcagtttccggatgcagttttttggcaagaaatcagcgaaatttttcgccagctgcagaaacaggcagcagaaatctataatcagagcctgatcgaactgtactacgagatttttatcaaaggcaaaggtattgcaaatgccagcagcgttgaacattatctgagtgatgtttgttatacccgtgcagcagaactgtttaaaaacgcagcaattgcaagcggtctgcgtagcaaaatcaaaagcaattttcgtctgaaagaactgaaaaacatgaaaagtggtctgccgaccaccaaaagcgataattttccgattccgctggttaaacagaaaggtggtcagtataccggttttgaaattagcaatcataatagcgacttcatcatcaagattccgtttggtcgttggcaggtcaaaaaagagattgataaatatcgtccgtgggagaaatttgactttgaacaggttcagaaaagcccgaaaccgattagcctgctgctgagcacccagcgtcgtaaacgtaataaaggttggagcaaagatgaaggcaccgaagccgaaatcaaaaaagttatgaatggcgattatcagaccagctacattgaagttaaacgtggcagcaaaatcggtgaaaaaagcgcatggatgctgaatctgagcattgatgttccgaaaattgataaaggtgtggatccgagcattattggtggtattgatgttggtgttaaatcaccgctggtttgcgcaattaacaatgcatttagccgttatagcatcagcgataacgacctgtttcacttcaacaagaaaatgtttgcacgtcgtcgtatcctgctgaaaaaaaaccgtcataaacgtgcaggtcatggtgcaaaaaacaaactgaaaccgatcaccattctgaccgaaaaaagtgaacgttttcgcaaaaagctgattgaacgttgggcatgtgaaatcgcggatttcttcattaaaaacaaagttggcaccgtgcagatggaaaatctggaaagcatgaaacgtaaagaggacagctattttaacattcgcctgcgtggcttttggccgtatgcagaaatgcagaacaaaatcgaattcaaactgaagcagtatggcatcgaaattcgtaaagttgcaccgaataataccagcaaaacctgtagcaaatgtggccatctgaacaactatttcaacttcgagtaccgcaagaaaaacaaattcccgcactttaaatgcgaaaaatgcaacttcaaagaaaacgccgattataatgcagccctgaatatttcaaacccgaaactgaaaagcaccaaagaggaaccgtaaatatttatactttattatccttcattgacaaaaatgagaatgttatcccagataacatttgatgtacacagattcacacttcactgataaagtggagaaccgcttcaccaaaagctgtcccttaggggattagaacttgagtgaaggtgggctgcttgcatcagcctaatgtcgagaagtgctttcttcggaaagtaaccctcgaaacaaattcatttttcctctccaattctgcacaaaaaaaggtgagtccttataaaccggcgtgcagaacgccggctcaccttttttcttcattcgattttatgcttaaaagccgtaaaaacgcggaattcggcgccgttgcagaacccgaatagacgaatgaaggaatgcaactaccttacaccgcttgcgaaagttgtcagaagataatcttgcagaacccgaatagacgaatgaaggaatgcaatcttgacagagcccgattgcgttatctccaggagaaacatataaaagcatcaaccgctgatcggactagagtcacactggctcaccttcgggtgggcctttctgcgtttatacctagggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgttactagtgcttggattctcaccaataaaaaacgcccggcggcaaccgagcgttctgaacaaatccagatggagttctgaggtcattactggatctatcaacaggagtccaagcgagctcgatatcaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccagatatcgacgtcttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgatccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcat

SEQ ID NO: 496 - DNA, 4607 bp, Artificial Sequence
  Synthetic sequence
ttacttttatctaatctagacatcattaattcctaatttttgttgacactctatcgttgatagagttattttaccactccctatcagtgatagagaaaagaattcaaaagatctaaagaggagaaaggatctatggccaaaaacaccattaccaaaacactgaaactgcgtattgtgcgtccgtataatagcgcagaagtggaaaaaattgttgccgacgaaaaaaacaaccgcgaaaaaatcgcactggaaaagaacaaagacaaagtgaaagaagcctgcagcaaacatctgaaagttgcagcatattgtaccacacaggttgaacgtaatgcatgcctgttttgtaaagcacgtaaactggatgacaaattctaccaaaaactgcgtggtcagtttccggatgcagttttttggcaagaaatcagcgaaatttttcgccagctgcagaaacaggcagcagaaatctataatcagagcctgatcgaactgtactacgagatttttatcaaaggcaaaggtattgcaaatgccagcagcgttgaacattatctgagtgatgtttgttatacccgtgcagcagaactgtttaaaaacgcagcaattgcaagcggtctgcgtagcaaaatcaaaagcaattttcgtctgaaagaactgaaaaacatgaaaagtggtctgccgaccaccaaaagcgataattttccgattccgctggttaaacagaaaggtggtcagtataccggttttgaaattagcaatcataatagcgacttcatcatcaagattccgtttggtcgttggcaggtcaaaaaagagattgataaatatcgtccgtgggagaaatttgactttgaacaggttcagaaaagcccgaaaccgattagcctgctgctgagcacccagcgtcgtaaacgtaataaaggttggagcaaagatgaaggcaccgaagccgaaatcaaaaaagttatgaatggcgattatcagaccagctacattgaagttaaacgtggcagcaaaatcggtgaaaaaagcgcatggatgctgaatctgagcattgatgttccgaaaattgataaaggtgtggatccgagcattattggtggtattgatgttggtgttaaatcaccgctggtttgcgcaattaacaatgcatttagccgttatagcatcagcgataacgacctgtttcacttcaacaagaaaatgtttgcacgtcgtcgtatcctgctgaaaaaaaaccgtcataaacgtgcaggtcatggtgcaaaaaacaaactgaaaccgatcaccattctgaccgaaaaaagtgaacgttttcgcaaaaagctgattgaacgttgggcatgtgaaatcgcggatttcttcattaaaaacaaagttggcaccgtgcagatggaaaatctggaaagcatgaaacgtaaagaggacagctattttaacattcgcctgcgtggcttttggccgtatgcagaaatgcagaacaaaatcgaattcaaactgaagcagtatggcatcgaaattcgtaaagttgcaccgaataataccagcaaaacctgtagcaaatgtggccatctgaacaactatttcaacttcgagtaccgcaagaaaaacaaattcccgcactttaaatgcgaaaaatgcaacttcaaagaaaacgccgattataatgcagccctgaatatttcaaacccgaaactgaaaagcaccaaagaggaaccgtaaatatttatactttattatccttcattgacaaaaatgagaatgttatcccagataacatttgatgtacacagattcacacttcactgataaagtggagaaccgcttcaccaaaagctgtcccttaggggattagaacttgagtgaaggtgggctgcttgcatcagcctaatgtcgagaagtgctttcttcggaaagtaaccctcgaaacaaattcatttttcctctccaattctgcacaaaaaaaggtgagtccttataaaccggcgtgcagaacgccggctcaccttttttcttcattcgattttatgcttaaaagccgtaaaaacgcggaattcggcgccgttgcagaacccgaatagacgaatgaaggaatgcaactaccttacaccgcttgcgaaagttgtcagaagataatcttgcagaacccgaatagacgaatgaaggaatgcaatcttgacagagcccgattgcgttatctccaggagaaacatataaaagcatcaaccgctgatcggactagagtcacactggctcaccttcgggtgggcctttctgcgtttatacctagggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgttactagtgcttggattctcaccaataaaaaacgcccggcggcaaccgagcgttctgaacaaatccagatggagttctgaggtcattactggatctatcaacaggagtccaagcgagctcgatatcaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccagatatcgacgtcttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcact

SEQ ID NO: 497 - DNA, 7556 bp, Artificial Sequence
  Synthetic sequence
acccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactatagggagaccacaacggtttccctctagtgccggctccggagagctctttaattaagcggccgccctgcaggactcgagttctagaaataattttgtttaactttaagaaggagatatacatatgaaatcttctcaccatcaccatcaccatcaccatcaccatggttcttctatgaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaattcgagctcgaacaacaacaacaataacaataacaacaacctcgggatcgaggaaaacctgtacttccaatccaatgcaatggccaaaaacaccattaccaaaacactgaaactgcgtattgtgcgtccgtataatagcgcagaagtggaaaaaattgttgccgacgaaaaaaacaaccgcgaaaaaatcgcactggaaaagaacaaagacaaagtgaaagaagcctgcagcaaacatctgaaagttgcagcatattgtaccacacaggttgaacgtaatgcatgcctgttttgtaaagcacgtaaactggatgacaaattctaccaaaaactgcgtggtcagtttccggatgcagttttttggcaagaaatcagcgaaatttttcgccagctgcagaaacaggcagcagaaatctataatcagagcctgatcgaactgtactacgagatttttatcaaaggcaaaggtattgcaaatgccagcagcgttgaacattatctgagtgatgtttgttatacccgtgcagcagaactgtttaaaaacgcagcaattgcaagcggtctgcgtagcaaaatcaaaagcaattttcgtctgaaagaactgaaaaacatgaaaagtggtctgccgaccaccaaaagcgataattttccgattccgctggttaaacagaaaggtggtcagtataccggttttgaaattagcaatcataatagcgacttcatcatcaagattccgtttggtcgttggcaggtcaaaaaagagattgataaatatcgtccgtgggagaaatttgactttgaacaggttcagaaaagcccgaaaccgattagcctgctgctgagcacccagcgtcgtaaacgtaataaaggttggagcaaagatgaaggcaccgaagccgaaatcaaaaaagttatgaatggcgattatcagaccagctacattgaagttaaacgtggcagcaaaatctgtgaaaaaagcgcatggatgctgaatctgagcattgatgttccgaaaattgataaaggtgtggatccgagcattattggtggtattgatgttggtgttaaatcaccgctggtttgcgcaattaacaatgcatttagccgttatagcatcagcgataacgacctgtttcacttcaacaagaaaatgtttgcacgtcgtcgtatcctgctgaaaaaaaaccgtcataaacgtgcaggtcatggtgcaaaaaacaaactgaaaccgatcaccattctgaccgaaaaaagtgaacgttttcgcaaaaagctgattgaacgttgggcatgtgaaatcgcggatttcttcattaaaaacaaagttggcaccgtgcagatggaaaatctggaaagcatgaaacgtaaagaggacagctattttaacattcgcctgcgtggcttttggccgtatgcagaaatgcagaacaaaatcgaattcaaactgaagcagtatggcatcgaaattcgtaaagttgcaccgaataataccagcaaaacctgtagcaaatgtggccatctgaacaactatttcaacttcgagtaccgcaagaaaaacaaattcccgcactttaaatgcgaaaaatgcaacttcaaagaaaacgccgattataatgcagccctgaatatttcaaacccgaaactgaaaagcaccaaagaggaaccgtaataacattggaagtggataacggatccgcgatcgcggcgcgccacctggtggccggccggtaccacgcgtgcgcgctgatccggctgctaacaaagcccgaaaggaagctgagttggctgctgccaccgctgagcaataactagcataaccccttggggcctctaaacgggtcttgaggggttttttgctgaaaggaggaactatatccggatatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagcttatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataacattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccat

SEQ ID NO: 498 - DNA, 30 bp, Artificial sequence
  Synthetic sequence
ttcatttgagcattaaatgtcaagttctgc

SEQ ID NO: 499 - DNA, 30 bp, Artificial sequence
  Synthetic sequence
ttcatttgagcattaagtgtcaagttctgc

SEQ ID NO: 500 - DNA, 21 bp, Artificial sequence
  Synthetic sequence
aaactcgtaattcacagttca

SEQ ID NO: 501 - DNA, 10 bp, Artificial Sequence
  Synthetic sequence
tatatatata

SEQ ID NO: 502 - DNA, 6 bp, Artificial Sequence
  Synthetic sequence
tatata

SEQ ID NO: 503 - DNA, 5 bp, Artificial Sequence
  Synthetic sequence
tatat

What is claimed is:

1. A method of guiding a CasY protein to a target sequence of a target nucleic acid,
    the method comprising contacting the target nucleic acid with an engineered and/or non-naturally occurring complex comprising:
    (a) a CasY protein;
    (b) a CasY guide RNA that comprises a guide sequence that hybridizes to a target sequence of the target nucleic acid, and comprises a region that binds to the CasY protein; and
    (c) a CasY transactivating noncoding RNA (CasYtrancRNA);
    wherein:
      (i) the CasY protein comprises an amino acid sequence having 95% or more identity with the CasYI sequence of SEQ ID NO: 1, and the CasY trancRNA comprises a nucleotide sequence having 98% or more identity with the CasYI trancRNA sequence of SEQ ID NO: 245; or
      (ii) the CasY protein comprises an amino acid sequence having 95% or more identity with the CasY2 sequence of SEQ ID NO: 2, and the CasYtrancRNA comprises a nucleotide sequence having 98% or more identity with the CasY2 trancRNA sequence of SEQ ID NO: 246; or
      (iii) the CasY protein comprises an amino acid sequence having 95% or more identity with the CasY4 sequence of SEQ ID NO: 4, and the CasYtrancRNA comprises a nucleotide sequence having 98% or more identity with the CasY4 trancRNA sequence of SEQ ID NO: 247.
2. The method of claim 1, wherein the method results in modification of the target nucleic acid, modulation of transcription from the target nucleic acid, or modification of a polypeptide associated with a target nucleic acid.
3. The method of claim 2, wherein the target nucleic acid is modified by being cleaved.
4. The method of claim 1, wherein the target nucleic acid is selected from: double stranded DNA, single stranded DNA, RNA, genomic DNA, and extrachromosomal DNA.
5. The method of claim 1, wherein the guide sequence and the region that binds to the CasY protein are heterologous to one another.
6. The method of claim 1, wherein said contacting results in genome editing.
7. The method of claim 1, wherein said contacting takes place outside of a bacterial cell and outside of an archaeal cell.
8. The method of claim 1, wherein said contacting takes place in vitro outside of a cell.
9. The method of claim 1, wherein said contacting takes place inside of a target cell.
10. The method of claim 9, wherein said contacting comprises: introducing into the target cell at least one of:
    (a) the CasY protein, or a nucleic acid encoding the CasY protein;
    (b) the CasY guide RNA, or a nucleic acid encoding the CasY guide RNA; and
    (c) the CasY trancRNA, or a nucleic acid encoding the CasY trancRNA.
11. The method of claim 10, wherein the nucleic acid encoding the protein is a non-naturally sequence that is codon optimized for expression in the target cell.
12. The method of claim 9, wherein the target cell is a eukaryotic cell.
13. The method of claim 9, wherein the target cell is in culture in vitro.
14. The method of claim 9, wherein the target cell is in vivo.
15. The method of claim 9, wherein the target cell is ex vivo.
16. The method of claim 12, wherein the eukaryotic cell is a plant cell, a fungal cell, a single cell eukaryotic organism, a mammalian cell, a reptile cell, an insect cell, an avian cell, a fish cell, a parasite cell, an arthropod cell, a cell of an invertebrate, a cell of a vertebrate, a rodent cell, a mouse cell, a rat cell, a primate cell, a non-human primate cell, or a human cell.
17. The method of claim 1, wherein said contacting further comprises: introducing a DNA donor template into the target cell.
18. The method of claim 1, wherein
    (i) the CasY protein comprises an amino acid sequence having the CasYI sequence of SEQ ID NO: 1, and the CasY trancRNA comprises a nucleotide sequence having the CasYI trancRNA sequence of SEQ ID NO: 245;
    (ii) the CasY protein comprises an amino acid sequence having the CasY2 sequence of SEQ ID NO: 2, and the CasY trancRNA comprises a nucleotide sequence having the CasY2 trancRNA sequence of SEQ ID NO: 246; or
    (iii) the CasY protein comprises an amino acid sequence having the CasY4 sequence of SEQ ID NO: 4, and the CasYtrancRNA comprises a nucleotide sequence having the CasY4 trancRNA sequence of SEQ ID NO: 247.

\* \* \* \* \*